United States Patent
Tamura et al.

(10) Patent No.: US 12,416,641 B2
(45) Date of Patent: *Sep. 16, 2025

(54) MICROORGANISM IDENTIFICATION METHOD

(71) Applicants: SHIMADZU CORPORATION, Kyoto (JP); MEIJO UNIVERSITY, Nagoya (JP)

(72) Inventors: Hiroto Tamura, Kani (JP); Naomi Yamamoto, Nagoya (JP); Teruyo Kato, Aisai (JP); Keisuke Shima, Kyoto (JP); Shinji Funatsu, Kyoto (JP)

(73) Assignees: SHIMADZU CORPORATION, Kyoto (JP); MEIJO UNIVERSITY, Nagoya (JP)

( * ) Notice: Subject to any disclaimer, the term of this patent is extended or adjusted under 35 U.S.C. 154(b) by 0 days.

This patent is subject to a terminal disclaimer.

(21) Appl. No.: 18/221,835

(22) Filed: Jul. 13, 2023

(65) Prior Publication Data
US 2024/0060987 A1  Feb. 22, 2024

Related U.S. Application Data

(63) Continuation of application No. 16/089,836, filed as application No. PCT/JP2016/060865 on Mar. 31, 2016, now Pat. No. 11,747,344.

(51) Int. Cl.
*G01N 33/00* (2006.01)
*C12Q 1/04* (2006.01)
*G01N 27/64* (2006.01)
*G01N 33/68* (2006.01)

(52) U.S. Cl.
CPC .......... *G01N 33/6851* (2013.01); *C12Q 1/04* (2013.01); *G01N 27/64* (2013.01); *G01N 2333/255* (2013.01)

(58) Field of Classification Search
CPC . G01N 33/6851; G01N 2333/255; C12Q 1/04
See application file for complete search history.

(56) References Cited

U.S. PATENT DOCUMENTS

| | | | | |
|---|---|---|---|---|
| 11,747,344 | B2 * | 9/2023 | Tamura | G01N 27/64 435/7.2 |
| 11,774,448 | B2 * | 10/2023 | Fukuyama | G01N 33/56916 436/173 |
| 2014/0288852 | A1 | 9/2014 | Ojima et al. | |
| 2020/0300862 | A1 | 9/2020 | Tamura et al. | |
| 2022/0003764 | A1 | 1/2022 | Fukuyama | |
| 2022/0003778 | A1 | 1/2022 | Fukuyama | |

FOREIGN PATENT DOCUMENTS

| | | |
|---|---|---|
| CN | 109313161 A | 2/2019 |
| JP | 2006191922 A | 7/2006 |
| JP | 2013085517 A | 5/2013 |
| JP | 2015-184020 A | 10/2015 |

OTHER PUBLICATIONS

EPO Communication dated Feb. 2, 2023 issued for the corresponding European Patent No. 3438655.
Letter from the opponent dated Jan. 27, 2023 (12 pages total).
Testimony of Séverine Franpois, Engineer, EU System Engineering & Support and Global Assets, bioMerieux dated Jan. 27, 2023 (8 pages total).
Testimony of Olivier Lafrique, Senior Global Customer Service Manager, Expert Microbiology & IT France, bioMerieux dated Jan. 26, 2023.
Summons to attend Oral Proceedings dated Oct. 5, 2022 issued by the European Patent Office in European Application No. 16896957.4.
Guillaume Grain, Translation of Bailiff report on SARAMIS Database V4.13, Oct. 2021, pp. 1-18 (18 pages total).
Dr. Ulrich Knauf, Translation of "Product notice SARAMISTm software update V.4.0 and knowledge base V.4.12.0 for VITEK'MS Plus and VITEK® MS RUO", Oct. 8, 2013 (1 page total).
Gekenidis et al. 2014 (Beyond the Matrix-Assisted Laser Desorption Ionization (MALDI) Biotyping Workflow: in Search of Microorganism-Specific Tryptic Peptides Enabling Discrimination of Subspecies; Applied and Environmental Microbiology; 80(14): 4234-4241). (Year: 2014).
Dieckmann et al. 2011 (Rapid Screening of Epidemiologically Important *Salmonella enterica* subsp. enterica Serovars by Whole-Cell Matrix-Assisted Laser Desorption Ionization-Time of Flight Mass Spectrometry; Applied and Environmental Microbiology; 77 (12), 4136-4146) (Year: 2011).

(Continued)

*Primary Examiner* — Mary Maille Lyons
(74) *Attorney, Agent, or Firm* — Sughrue Mion, PLLC

(57) ABSTRACT

Provided is a method of identifying a serovar of *Salmonella* bacteria including a step of subjecting a sample containing microorganisms to mass spectrometry to obtain a mass spectrum, a step of reading a mass-to-charge ratio m/z of a peak derived from a marker protein from the mass spectrum, and an identification step of identifying a serovar of *Salmonella* bacteria in the sample, based on the mass-to-charge ratio m/z, wherein the serovars of *Salmonella* bacteria are classified using cluster analysis using as an index the mass-to-charge ratio m/z derived from at least 12 types of ribosomal proteins S8, L15, L17, L21, L25, S7, SODa, peptidylprolyl isomerase, gns, YibT, YaiA and YciF as the marker proteins.

2 Claims, 80 Drawing Sheets

Specification includes a Sequence Listing.

(56) References Cited

OTHER PUBLICATIONS

Communication dated Nov. 23, 2021 from the European Patent Office in Application No. 16896957.4.
Maria-Theresia Gekenidis, et al. "Beyond the Matrix-Assisted Laser Desorption Ionization (MALDI) Biotyping Workflow: in Search of Microorganism-Specific Tryptic Peptides Enabling Discrimination of Subspecies", Applied and Environmental Microbiology, Jul. 2014, vol. 80, No. 14, pp. 4234-4241 (8 pages).
Martin Welker, et al. "Applications of whole cell matrix-assisted laser-desorption/ionization time-of-flight mass spectrometry in systematic microbiology", Systematic and Applied Microbiology, 2011, vol. 34, pp. 2-11 (10 pages).
Snehal Jadhav, et al. "Rapid identification and source-tracking of Listeria monocytogenes using MALDI-TOF mass spectrometry", International Journal of Food Microbiology, 2015, vol. 202, pp. 1-9 (9 pages total).
Dominik Ziegler, et al. "Ribosomal protein biomarkers provide root nodule bacterial identification by MALDI-TOF MS", Appl Microbiol Biotechnol, 2015, 16 pages total.
Prior Use document that contains different evidence relating to the instrument VITEK MS Plus and its open Database SARAMIS, 2015, 31 pages total.
Office Action dated Aug. 20, 2020 for the corresponding Chinese Patent Application No. 201680084370.5.
Chen, Xiu-jin et al., "Studies on the Protein Fingerprint of Salmonella by MALDI-TOF-MS", Journal of Food Science and Biotechnology, 2012, vol. 31, No. 11, 14 pages total.
Grimont, P., et al., "Antigenic Formulae of the Salmonella Serovars", 2007 9th edition, WHO Collaborating Centre for Reference and Research on Salmonella, Institut Pasteur, pp. 1-166 (167 pages).
Winfield, M., et al., "Role of Nonhost Environments in the Lifestyles of *Salmonella* and *Escherichia coli*", Applied and Environmental Microbiology, vol. 69, No. 7, 2003, pp. 3687-3694 (8 pages).
Akiba, M., et al., "Rapid identification of *Salmonella enferica* serovars, Typhimurium, Choleraesuis, Infantis, Hadar, Enteritidis, Dublin and Gallinarum, by multiplex PCR", Journal of Microbiological Methods, vol. 85, 2011, pp. 9-15 (7 pages).
Hong., Y., et al.," Rapid screening of *Salmonella enterica* serovars Enteritidis, Hadar, Heidelberg and Typhimurium using a serologically-correlative allelotyping PCR targeting the O and H antigen alleles", BMC Microbiology, 2008, vol. 8, No. 178, 8 pages.
Tenover, F., et al., "Interpreting Chromosomal DNA Restriction Patterns Produced by Pulsed-Field Gel Electrophoresis: Criteria for Bacterial Strain Typing", Journal Of Clinical Microbiology, 1995, vol. 33, No. 9, pp. 2233-2239 (7 pages).
Achtman, M., et al., " Multilocus Sequence Typing as a Replacement for Serotyping in *Salmonella enterica*", PLoS Pathogens, 2012, vol. 8, Issue 6, pp. 1-19 (19 pages).
Seng, P., et al., " MALDI-TOF-mass spectrometry applications in clinical microbiology", Future Microbiology, 2010, vol. 5, No. 11, pp. 1733-1754 (22 pages).
Kuhns, M., et al., " Rapid Discrimination of *Salmonella enterica* Serovar Typhi from Other Serovars by MALDI-TOF Mass Spectrometry", PLoS One, 2012, vol. 7, Issue 6, 1-6 pages (6 pages).
Dieckmann, R., et al.," Rapid Classification and Identification of Salmonellae at the Species and Subspecies Levels by Whole-Cell Matrix-Assisted Laser Desorption Ionization-Time of Flight Mass Spectrometry", Applied and Environmental Microbiology, 2008, vol. 74, No. 24, pp. 7767-7778 (12 pages).
Dieckmann, R., et al., "Rapid Screening of Epidemiologically Important *Salmonella enterica* subsp. *enterica* Serovars by Whole-Cell Matrix-Assisted Laser Desorption Ionization-Time of Flight Mass Spectrometry", Applied and Environmental Microbiology, 2011, vol. 77, No. 12, pp. 4136-4146 (11 pages).
Ojima-Kato, T., et al., "Discrimination of *Escherichia coli* 0157. 026 and 0111 from Other Serovars by MALDI-TOF MS Based on the S70-GERMS Method", PLoS ONE, 2014, vol. 9, Issue 11, pp. 1-11 (11 pages).

Written Opinion of the International Searching Authority, dated Jun. 14, 2016 from the International Bureau in counterpart International application No. PCT/JP2016/060865.
Annexes (other than cited documents) regarding appeal procedure, Severnine Francios, Biomerieux, Sep. 29, 2021 (3 pages total).
Forwarding of Submissions to Parties issued by the European Patent Office Boards of Appeal on Feb. 8, 2024 in Application No. 16896957.4 (46 pages total).
Letter Accompanying subsequently filed items issued Feb. 5, 2024 in Application No. 16/896,957.4 (43 pages total).
Non-Patent Literature cited during the appeal procedure issued Apr. 5, 2022 in European Application No. 16896957.4 (22 pages total).
Non-Patent Literature cited during the appeal procedure issued Mar. 17, 2023 in European Application No. 16896957.4 (12 pages total).
Letter Accompanying subsequently filed items issued Feb. 5, 2024 by the European Patent Office in European Application No. 16896957.4 (1 page total).
Annexes (other than cited documents) regarding appeal procedure issued Jul. 18, 2016, "VITEK MS Plus—SARAMIS KB 4.14 Update," No. 3057, Biome Rieux (2 pages total).
Annexes (other than cited documents) regarding appeal procedure issued Sep. 29, 2023, "Testimony of Oliver Lafrique, Senior Global Customer Service Manager, Expert Microbiology & IT France within bioMerieux Company," Biomerieux (1 page total).
Annexes (other than cited documnets) regarding appeal procedure, "Ulusal Klink Mikrobiyoloji Kongresi," 2015, Kongre Kitabi (4 pages total).
Annexes (other than cited documents) regarding appeal procedure, "SARAMIS update KB V. 4.13.0," No. 2031, Biomerieux, Apr. 4, 2014 (5 pages total).
Annexes (other than cited documents) regarding appeal procedure, "VITEK MS," RUO SARAMIS KB V4.13.0, Ref 417388 (1 pages total).
Annexes (other than cited documents) regarding appeal procedure, "Proces Verbal De Constat," Expedition, Reference C22938, 2021, pp. 1-13 (13 pages total).
Annexes (other than cited documents) regarding appeal procedure, English Machine Translation of JP2007-316063, pp. 1-26 (26 pages total).
Annexes (other than cited documents) regarding appeal procedure, "Proces-Verbal De Constat," Expedition-SALMONELLA, Selarl Adrastee, pp. 1-36 (36 pages total).
Annexes (other than cited documents) regarding appeal procedure, "VITEK MS Plus, VITEK MS IVD and VITEK MS Research Use Only software combination," VITEK MS Components, Sep. 29, 2015, pp. 1-4 (4 pages total).
Annexes (other than cited documents) regarding appeal procedure, "Check-List Et Fiches De Lancement ProDuits Logiciels/ Documentation Format DVD," BioMerieux, Feb. 12, 2024, pp. 1-4 (4 pages total).
Annexes (other than cited documents) regarding appeal procedure, "SARAMIS Softwareupdate V.4.0 und Wissensdatenbank V.4.12.0 fur VITEK MS Plus und VITEK MS Ruo," Oct. 8, 2013 (1 page total).
Annexes (other than cited documents) regarding appeal procedure, Ralf Dieckmann, et al., "Rapid Screening of Epidemiologically Important *Salmonella enterica* subsp. enterica Serovars by Whole-Cell Matrix-Assisted Laser Desorption Ionization—Time of Flight Mass Spectrometry," Applied and Environmental Microbiology, Jun. 2011, vol. 77, No. 12, pp. 4136-4146 (11 pages total).
Annexes (other than cited documents) regarding appeal procedure, "List of Sales Orders," pp. 1-19 (19 pages total).
Annexes (other than cited documents) regarding appeal procedure, Vitek MS, Biomerieux, Mar. 2014 (1 page total).
Annexes (other than cited documents) regarding appeal procedure, "Master Content Description and Installation procedure forVITEK MS RUO—SARAMIS KB 4.13.0," VITEK-MS, Feb. 11, 2014, No. 009946, Revision 01.A ( 2 pages total).
Annexes (other than cited documents) regarding appeal procedure, Gulsen Hascelik, et al., "Identification of Viridans Streptococks Isolated From Clinical Samples With BD Phoenix, VITEK MS, MALDI Biotyper and Comparison With 16S RDNA Gene Sequence," PS014, p. 167 (1 page total).

(56) References Cited

OTHER PUBLICATIONS

Annexes (other than cited documents) regarding appeal procedure, "Definition De Produit D'un Media Informatique (Logicil ET/OU Documentation)," VITEK MS RUO SARAMIS KB V4.13.0, bioMerleux, Document No. 009530 Rev 02.A, pp. 1-10 (10 pages total).

Annexes (other than cited documents) regarding appeal procedure, Dominik Ziegler, et al., "Ribosomal protein biomarkers provide root nodule bacterial identification by MALDI-TOF MS," App. Microbiol. Biotechnol., Mar. 18, 2015, pp. 1-16 (16 pages total).

Annexes (other than cited documents) regarding appeal procedure, "Industrialisation Des Media Informatiques ET Des Documentations Papiers," Biomerieux, 2014, Doc. Number 018698, pp. 1-12 (12 pages total).

Annexes (other than cited documents) regarding appeal procedure, Maria-Theresia Gekenidis, et al., "Beyond the Matrix-Assisted Laser Desorption Ionization (MALDI) Biotyping Workflow: in Search of Microorganism-Specific Tryptic Peptides Enabling Discrimination of Subspecies," Applied and Environmental Microbiology, Jul. 2014, vol. 80, No. 14, pp. 4234-4241 (8 pages total).

Annexes (other than cited documents) regarding appeal procedure, Martin Welker, et al., "Applications of whole-cell matrix-assisted laser-desorption/ionization time-of-flight mass spectrometry in systematic microbiology," Systematic and Applied Microbiology, 34, 2011, pp. 2-11 (10 pages total).

Annexes (other than cited documents) regarding appeal procedure, Snehal Jadhav, et al., "Rapid identification and source-tracking of Listeria monocytogenes using MALDI-TOF mass spectrometry," International Journal of Food Microbiology, 2015, vol. 202, pp. 1-9 (9 pages total).

Annexes (other than cited documents) regarding appeal procedure, "System Impact Study Form, VITEK MS RUO SARAMIS KB V4.13.0, FGM/RDS/M00094," Rev. 1, pp. 1-22 (22 pages total).

Letter accompanying subsequently filed items (Lettre d'accompagnement relative a des pieces produites ulterieurement) issued by the European Patent Office on Sep. 29, 2023 in Application No. 16896957.4.

Patent Document Cited During the Appeal Procedure, European Application No. 3438276B1.

Statement of Grounds of Appeal issued Sep. 29, 2023 for European Application No. 3438655B1.

Patent Document Cited During the Appeal Procedure, Japanese Application No. 2007-316063A.

Annex to the Communication, Opposition, issued Jun. 1, 2023 in Application No. 16896957.4.

Grounds for the Decision (Annex), Opposition, Summary of Facts and Submissions, issued Jun. 1, 2023 in Application No. 16896957.4.

Citation in Opposition Procedure, No. 9, List of Sales Orders, Mar. 24, 2023.

Citation in Opposition Procedure, No. 10, VITEK MS, RUO SARAMIS KB V4.13.0, Biomerieux, Ref. 417388.

Citation in Opposition Procedure, No. 11, "Master Content Description and Installation Procedure for VITEK MS RUO—SARAMIS KB 4.13.0," VITEK-MS, No. 009946, Revision 01.A (2 pages total).

Citation in Opposition Procedure, No. 12, "Definition de Produit D'Un Media Informatique (Logicel et/ Ou Documentation)," VITEK MS RUO SARAMIS KB V4.13.0, BioMerleux, Doc No. 009530, Rev 02.A, pp. 1-9 (10 pages total).

Citation in Opposition Procedure, No. 13, "Industrialisation Des Media Informatiques Et Des Documentations Papiers," Mar. 24, 2023, Doc. Number 018698, Revision 03.A (12 pages total).

Citation in Opposition Procedure, No. 14, "Check-List Fiches de Lancement Produits Logiciels / Documentation Format DVD," BioMerieux, Doc. Number 018940, Feb. 12, 2024, Rev03.A (4 pages total).

Citation in Opposition Procedure, No. 15, "VITEK MS RUO SARAMIS KB V4.13.0 FGM/RDS/M00094," BioMerieux, System Impact Study Form, Rev 02.B, pp. 1-22 (22 pages total).

Citation in Opposition Procedure, No. 16, "Proces-Verbal De Constat," Expedition-Salmonella, Selarl Adrastee, pp. 1-36 (36 pages total).

Consolidated list of Cited Opposition Documents, issued Mar. 24, 2023 by the European Patent Office in Application No. 16896957.4.

Letter accompanying subsequently filed items (Lettre d'accompagnement relative a des pieces produites ulterieurement) issued by the European Patent Office issued Mar. 24, 2023 in Application No. 16896957.4.

Written Submission, Opponent Communication—before Oral Proceedings on Mar. 24, 2023.

Brief Communication—Opposition Proceedings, issued Mar. 20, 2023 in European Application No. 16896957.4.

Written Submission in preparation of oral proceedings, issued Mar. 17, 2023 by the European Patent Office in Application No. 16896957.4.

Brief Communication, Opposition Proceedings, issued Mar. 6, 2023 by the European Patent Office in Application No. 16896957.4.

Brief Communication, Opposition Proceedings, issued Mar. 28, 2023 by the European Patent Office in Application No. 16896957.4.

Transmittal of Decision, Summons, Opposition, issued Jun. 1, 2023 by the European Patent Office in Application No. 16896957.4.

Teruyo Ojima-Kato et al., "Application of proteotyping Strain Solution™ ver. 2 software and theoretically calculated mass database in MALDI-TOF MS typing of Salmonella serotype", Applied Microbiology and Biotechnology, 2017, pp. 8557-8569, vol. 101, issue 23-24.

Japanese Office Action dated May 23, 2023 in Japanese Application No. 2020-076955.

First Office Action dated Jan. 12, 2024 issued for Chinese Patent Application No. 202110439668.6.

\* cited by examiner

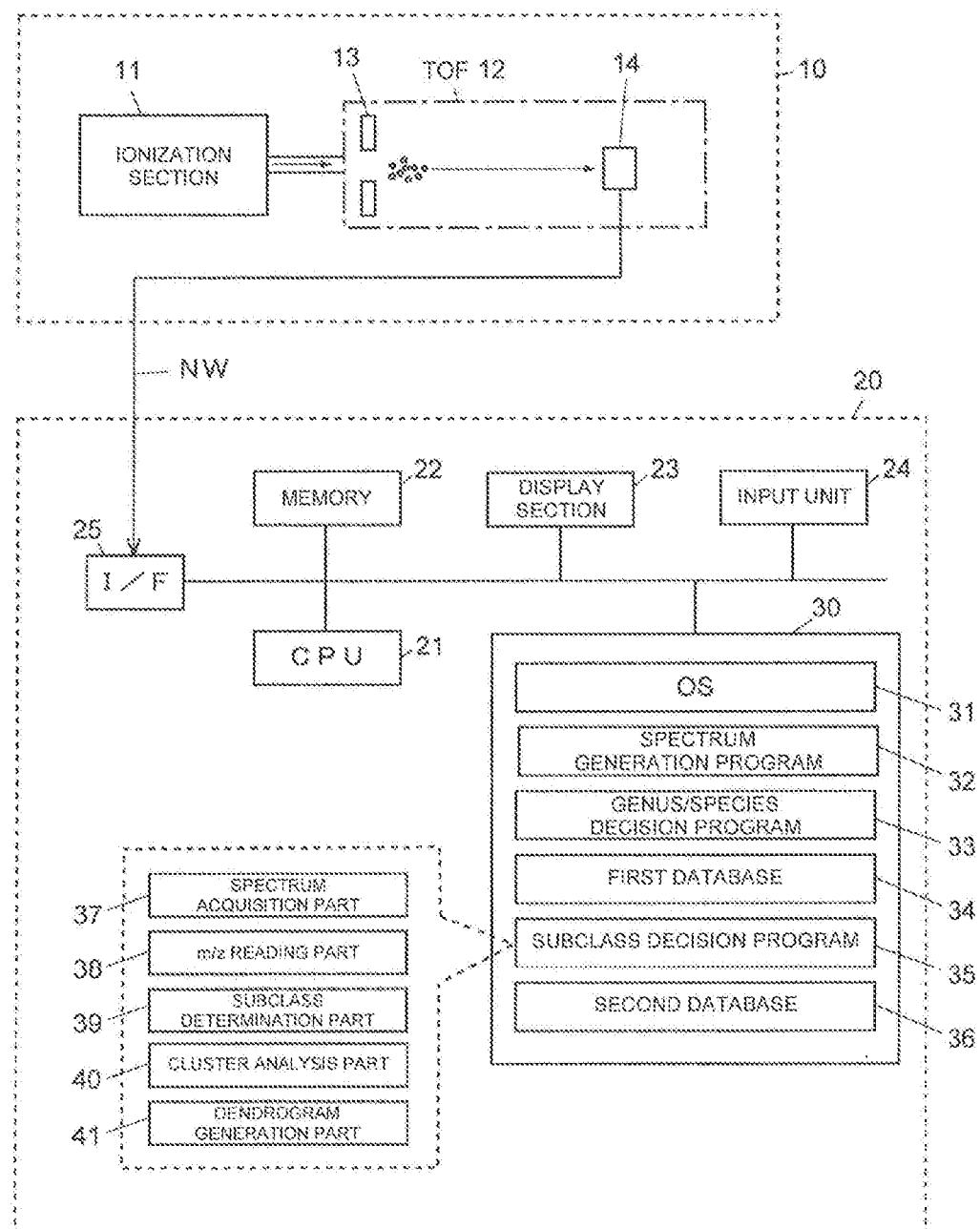

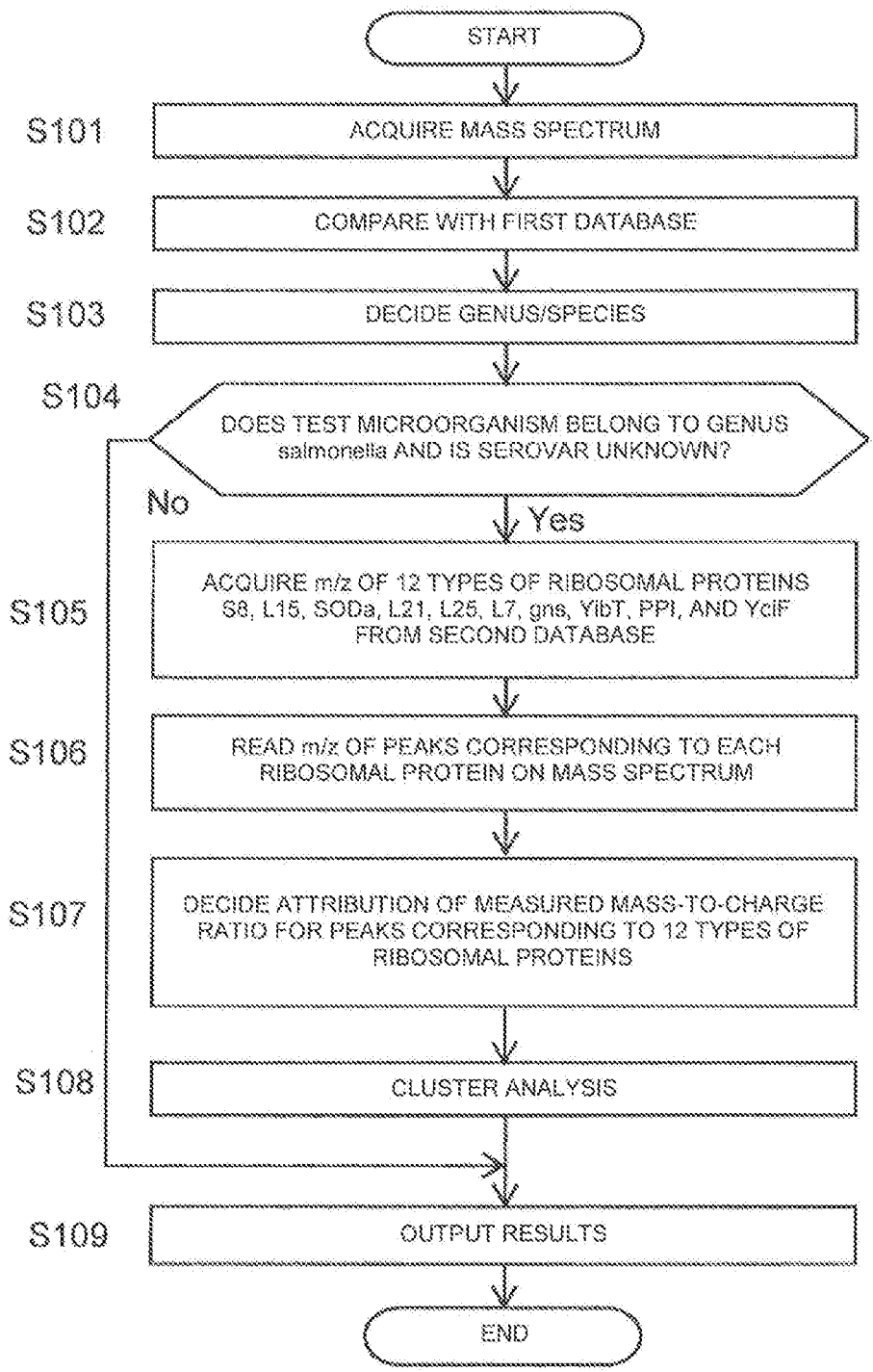

Fig. 3

| No. | Genus | Species | Subspecies | Serovar | Agglutinated O serum | Name of strain | Acquisition source |
|---|---|---|---|---|---|---|---|
| 1 | Salmonella | enterica | enterica | Typhimurium | O4 | NBRC13245T | NBRC |
| 2 | Salmonella | enterica | enterica | Enteritidis | O9 | GTC00131 | NBRP |
| 3 | Salmonella | enterica | enterica | Enteritidis | O9 | GTC08491 | NBRP |
| 4 | Salmonella | enterica | enterica | Enteritidis | O9 | GTC08838 | NBRP |
| 5 | Salmonella | enterica | enterica | Enteritidis | O9 | GTC08914 | NBRP |
| 6 | Salmonella | enterica | enterica | Enteritidis | O9 | GTC09421 | NBRP |
| 7 | Salmonella | enterica | enterica | Enteritidis | O9 | GTC09468 | NBRP |
| 8 | Salmonella | enterica | enterica | Gallinarum Pullorum | O9 | NBRC3163 | NBRC |
| 9 | Salmonella | enterica | enterica | Enteritidis | O9 | NBRC3313 | NBRC |
| 10 | Salmonella | enterica | enterica | Typhimurium | O4 | NBRC12529 | NBRC |
| 11 | Salmonella | enterica | enterica | Typhimurium | O4 | NBRC14193 | NBRC |
| 12 | Salmonella | enterica | enterica | Typhimurium | O4 | NBRC14194 | NBRC |
| 13 | Salmonella | enterica | enterica | Typhimurium | O4 | NBRC14209 | NBRC |
| 14 | Salmonella | enterica | enterica | Typhimurium | O4 | NBRC14210 | NBRC |
| 15 | Salmonella | enterica | enterica | Typhimurium | O4 | NBRC14211 | NBRC |
| 16 | Salmonella | enterica | enterica | Typhimurium | O4 | NBRC14212 | NBRC |
| 17 | Salmonella | enterica | enterica | Typhimurium | O4 | NBRC15131 | NBRC |
| 18 | Salmonella | enterica | enterica | Minnesota | O21 | NBRC15182 | NBRC |
| 19 | Salmonella | enterica | enterica | Minnesota | O21 | NBRC15183 | NBRC |
| 20 | Salmonella | enterica | enterica | Minnesota | O21 | NBRC15184 | NBRC |
| 21 | Salmonella | enterica | enterica | Minnesota | O21 | NBRC15185 | NBRC |
| 22 | Salmonella | enterica | enterica | Minnesota | O21 | NBRC15186 | NBRC |
| 23 | Salmonella | enterica | enterica | Minnesota | O21 | NBRC15187 | NBRC |
| 24 | Salmonella | enterica | enterica | Abony | O4 | NBRC105797 | NBRC |
| 25 | Salmonella | enterica | enterica | Choleraesuis | O7 | NBRC105684 | NBRC |
| 26 | Salmonella | enterica | enterica | Typhimurium | O4 | NBRC105726 | NBRC |
| 27 | Salmonella | enterica | enterica | UN_O7 | O7 | JCM3819 | JCM |
| 28 | Salmonella | enterica | enterica | Minnesota | O21 | NBRC15335 | NBRC |
| 29 | Salmonella | enterica | enterica | Enteritidis | O9 | GTC03481 | NBRP |
| 30 | Salmonella | enterica | enterica | Braenderup | O7 | GTC03482 | NBRP |
| 31 | Salmonella | enterica | enterica | Pakistan | O8 | GTC09483 | NBRP |
| 32 | Salmonella | enterica | enterica | Typhimurium* | O4 | GTC09548 | NBRP |
| 33 | Salmonella | enterica | enterica | Infantis | O7 | ATCC BAA-1675 | ATCC |
| 34 | Salmonella | enterica | enterica | Thompson | O7 | ATCC BAA-1738 | ATCC |
| 35 | Salmonella | enterica | enterica | Saintpaul | O4 | ATCC 9712 | ATCC |
| 36 | Salmonella | enterica | enterica | Infantis | O7 | jfrlSe1402-1 | Japan Food Research Laboratories |
| 38 | Salmonella | enterica | enterica | Brandenburg | O4 | jfrlSe1402-3 | Japan Food Research Laboratories |
| 39 | Salmonella | enterica | enterica | Infantis | O7 | jfrlSe1402-4 | Japan Food Research Laboratories |
| 40 | Salmonella | enterica | enterica | Brandenburg | O4 | jfrlSe1402-5 | Japan Food Research Laboratories |
| 41 | Salmonella | enterica | enterica | Rissen | O7 | jfrlSe1402-6 | Japan Food Research Laboratories |
| 42 | Salmonella | enterica | enterica | Orion | O3,10 | jfrlSe1402-7 | Japan Food Research Laboratories |
| 43 | Salmonella | enterica | enterica | Rissen | O7 | jfrlSe1402-8 | Japan Food Research Laboratories |
| 44 | Salmonella | enterica | enterica | Rissen | O7 | jfrlSe1402-9 | Japan Food Research Laboratories |
| 45 | Salmonella | enterica | enterica | Rissen | O7 | jfrlSe1402-10 | Japan Food Research Laboratories |
| 46 | Salmonella | enterica | enterica | Rissen | O7 | jfrlSe1402-11 | Japan Food Research Laboratories |
| 47 | Salmonella | enterica | enterica | Rissen | O7 | jfrlSe1402-12 | Japan Food Research Laboratories |
| 48 | Salmonella | enterica | enterica | Mbandaka | O7 | jfrlSe1402-13 | Japan Food Research Laboratories |
| 49 | Salmonella | enterica | enterica | Mbandaka | O7 | jfrlSe1402-14 | Japan Food Research Laboratories |
| 50 | Salmonella | enterica | enterica | Orion | O3,10 | jfrlSe1402-15 | Japan Food Research Laboratories |
| 51 | Salmonella | enterica | enterica | Altona | O8 | jfrlSe1409-1 | Japan Food Research Laboratories |
| 52 | Salmonella | enterica | enterica | Istanbul | O8 | jfrlSe1409-2 | Japan Food Research Laboratories |
| 53 | Salmonella | enterica | enterica | Senftenberg | O1,3,19 | jfrlSe1409-3 | Japan Food Research Laboratories |
| 54 | Salmonella | enterica | enterica | UN_O13 | O13 | jfrlSe1409-4 | Japan Food Research Laboratories |
| 55 | Salmonella | enterica | enterica | UN_O1,3,19 | O1,3,19 | jfrlSe1409-5 | Japan Food Research Laboratories |
| 56 | Salmonella | enterica | enterica | Montevideo | O7 | jfrlSe1409-6 | Japan Food Research Laboratories |
| 57 | Salmonella | enterica | enterica | UN_O1,3,19 | O1,3,19 | jfrlSe1409-7 | Japan Food Research Laboratories |
| 58 | Salmonella | enterica | enterica | UN_O18 | O18 | jfrlSe1409-8 | Japan Food Research Laboratories |
| 61 | Salmonella | enterica | enterica | UN_O1,3,19 | O1,3,19 | jfrlSe1409-11 | Japan Food Research Laboratories |
| 67 | Salmonella | enterica | enterica | UN_O7 | O7 | jfrlSe1409-17 | Japan Food Research Laboratories |
| 71 | Salmonella | enterica | enterica | Amsterdam | O3,10 | jfrlSe1409-21 | Japan Food Research Laboratories |
| 99 | Salmonella | enterica | enterica | Manhattan O6,8:d:1,5 | O8 | HyogoSO11001 | Hyogo Prefectural Institute of Public Health Science |
| 100 | Salmonella | enterica | enterica | Schwarzengrund O4:d:1,7 | O4 | HyogoSO12004 | Hyogo Prefectural Institute of Public Health Science |
| 103 | Salmonella | enterica | enterica | Schwarzengrund O4:d:1,7 | O4 | HyogoSO13003 | Hyogo Prefectural Institute of Public Health Science |
| 106 | Salmonella | enterica | enterica | Schwarzengrund O4:d:1,7 | O4 | HyogoSO14002 | Hyogo Prefectural Institute of Public Health Science |

ATCC: American Type Culture Collection
JCM: Riken Microbe Division / Japan Collection of Microorganisms
NBRC: Biological Resource Center, NITE
NBRP: National Bioresource Project

Fig. 4

| Agglutinated_O serum | Serovar | Number of strains |
|---|---|---|
| O1,3,19 | Senftenberg | 1 |
| O1,3,19 | UN | 3 |
| O3,10 | Amsterdam | 1 |
| O3,10 | Orion | 2 |
| O4 | Abony | 1 |
| O4 | Brandenburg | 2 |
| O4 | Saintpaul | 1 |
| O4 | Schwarzengrund | 3 |
| O4 | Typhimurium | 10 |
| O4 | UN | 1 |
| O7 | Braenderup | 1 |
| O7 | Choleraesuis | 1 |
| O7 | Infantis | 3 |
| O7 | Mbandaka | 2 |
| O7 | Montevideo | 1 |
| O7 | Rissen | 6 |
| O7 | Thompson | 1 |
| O7 | UN | 2 |
| O8 | Altona | 1 |
| O8 | Istanbul | 1 |
| O8 | Manhattan | 1 |
| O8 | Pakistan | 1 |
| O9 | Enteritidis | 8 |
| O9 | Gallinarum Pullorum | 1 |
| O13 | UN | 1 |
| O18 | UN | 1 |
| O21 | Minnesota | 7 (Confirmed by PCR) |
|  | 22 serovars | 64 strains |

Fig. 5

| Name | Sequence (5'-3') | Use |
|---|---|---|
| Ec-S10-F | AAGAACGGTTACACTCTCCC (SEQ ID NO:1) | Amplification and sequence analysis of S10 region |
| Se-S10-R | ATGTCGCCTACGCCTGCGTAGCG (SEQ ID NO:2) | Amplification and sequence analysis of S10 region |
| EcW 3110-S10-10 | GCTGGCATGATTCGTGAAGAACG (SEQ ID NO:3) | Sequence analysis of S10 region |
| EcW 3110-S10-3 | TGCTGAAGTAACTGGTTCCGG (SEQ ID NO:4) | Sequence analysis of S10 region |
| EcW 3110-S10-5 | CATAACGTAGAAATGAAACCAGG (SEQ ID NO:5) | Sequence analysis of S10 region |
| EcW 3110-S10-8 | AGCGTCGCTGATGTTACAAC (SEQ ID NO:6) | Sequence analysis of S10 region |
| Se-S10-1 | ATCAATCGTAATGGGTGTGAG (SEQ ID NO:7) | Sequence analysis of S10 region |
| Se-S10-2 | AAGCCGGAAGCGGGTCACTTTG (SEQ ID NO:8) | Sequence analysis of S10 region |
| Se-S10-3 r | CTTTTTGACTGTGGTGCCTGC (SEQ ID NO:9) | Sequence analysis of S10 region |
| Se-S10-5f | CGTTCTCTCAAGAAAGGTCC (SEQ ID NO:10) | Sequence analysis of S10 region |
| Se-S10-6r | GCCGATTACACCATAAGTGG (SEQ ID NO:11) | Sequence analysis of S10 region |
| Se-S10-7r | TAGCACGACGTGCTGCTTCGAT (SEQ ID NO:12) | Sequence analysis of S10 region |
| Se-S10-9 | TCCGTACTCTGCAAGGTCGCGTG (SEQ ID NO:13) | Sequence analysis of S10 region |
| Se-S10-11 | ACTCCGGTGCACGTCGCGTAATG (SEQ ID NO:14) | Amplification and sequence analysis of spc region |
| EcW 3110-spc-R | AGCAGTCTGCGTTTCAGCTC (SEQ ID NO:15) | Amplification and amplification of sequence analysis region of spc region |
| EcW 3110-spc-2 | ATTGTTGAAGGTATCAACCTG (SEQ ID NO:16) | Sequence analysis of spc region |
| EcW 3110-spc-2r | TTACCGGTTAACACGATAAC (SEQ ID NO:17) | Sequence analysis of spc region |
| EcW 3110-spc-3 | TCGTGGTAACTACAGCATG (SEQ ID NO:18) | Sequence analysis of spc region |
| EcW 3110-spc-4 | ACCATGCCTTCCTCCAAG CT (SEQ ID NO:19) | Sequence analysis of spc region |
| EcW 3110-spc-6 | ATGCTGCCCGTGAAGCTGGC (SEQ ID NO:20) | Sequence analysis of spc region |
| EcW 3110-spc-7 | ATCGGTCGTCTGCCGAAACAC (SEQ ID NO:21) | Sequence analysis of spc region and amplification of alpha region |
| EcW 3110-spc-9 | GTCACCATGCCTTCCTCCAAG (SEQ ID NO:22) | Sequence analysis of spc region |
| Se-spc-1 | AATGTGTATCAAGGTTCTGGG (SEQ ID NO:23) | Sequence analysis of spc region |
| Se-spc-8 | CTTCACTAAGAAGCTGCAGCTG (SEQ ID NO:24) | Sequence analysis of spc region |
| Se-spc-3r2 | ATATCCAAACCACGAACGCG (SEQ ID NO:25) | Sequence analysis of spc region |
| Se-spc-8r | GATGTGAGCCATCTTACACCTCT (SEQ ID NO:26) | Sequence analysis of spc region |
| EcW 3110-alpha-5 | TGCGGACATTAACGAACACCTG (SEQ ID NO:27) | Sequence analysis of alpha region |
| EcW 3110-alpha-6 | TGCCTACAATGTTGAAGCAGCG (SEQ ID NO:28) | Sequence analysis of alpha region |
| Se_alpha-7 | AATCATCAAGACGACCCTGCC (SEQ ID NO:29) | Sequence analysis of alpha region |
| Se-alp-3r | CGCGATAGCAACCAAGATCCA (SEQ ID NO:30) | Sequence analysis of alpha region |
| Se-alp-4r | CGCGAACGCCAGACTTAAGGA (SEQ ID NO:31) | Sequence analysis of alpha region |
| Se-alp-5r | ACTCTGTCACAGAACCCTGCA (SEQ ID NO:32) | Sequence analysis of alpha region |
| Se-alpha-2r | TGTACTGGCTGATCTTACGACG (SEQ ID NO:33) | Sequence analysis of alpha region |
| Se-alpha-8 | GGTTCATCCAACGCTGGCAG (SEQ ID NO:34) | Sequence analysis of alpha region |
| Se-alp-R2 | ATATGACGCTCTGCCCACTG (SEQ ID NO:35) | Amplification and sequence analysis of alpha region |
| Se-SODa-F | GCCGTAACGTTTATAACCCTGG (SEQ ID NO:36) | Amplification of SOD gene |
| Se-SODa-R | ACACGTCAACCGGATAATGCA (SEQ ID NO:37) | Amplification of SOD gene |
| Se-SODa-1f | ATGAACCAACTGCTTACGC (SEQ ID NO:38) | Sequence analysis of SOD gene |
| Se-L21-F | CGTTACCGTATGCGTTGTGT (SEQ ID NO:39) | Amplification of L21 gene |
| Se-L21-R | GCACAGCCACACGGGTATAT (SEQ ID NO:40) | Amplification of L21 gene |
| Se-L21-1f | CACTTGTCAAAGCCGTGCAA (SEQ ID NO:41) | Sequence analysis of L21 gene |
| Se-L21-1r | GTAAAAAGCCCCGGCAACAGG (SEQ ID NO:42) | Sequence analysis of L21 gene |
| Se-S7-F | GCGATTGAAGGTAACCGCTT (SEQ ID NO:43) | Amplification and sequence analysis of S7 gene |
| Se-S7-R | ATGTGCGCACTGATACCGAT (SEQ ID NO:44) | Amplification and sequence analysis of S7 gene |
| Se-S7-f | GTCGTCAGGGTTGACTATACT (SEQ ID NO:45) | Amplification and sequence analysis of S7 gene |
| Se-STM1513-F | GCACAGGGCGACTAGATTTAG (SEQ ID NO:46) | Amplification and sequence analysis of STM1513 gene |
| Se-STM1513-R | GCCCTCGCTGAATTGCTTTTTC (SEQ ID NO:47) | Amplification and sequence analysis of STM1513 gene |
| Se-gns-2-F | CATGACGACACTGTCTTATTGC (SEQ ID NO:48) | Amplification and sequence analysis of gns gene |
| Se-gns-2-R | TCGGTAAACCAGTCACCACT (SEQ ID NO:49) | Amplification and sequence analysis of gns gene |
| Se-YbT-F | TAAACTCAAATAAGCGRCCGCG (SEQ ID NO:50) | Amplification and sequence analysis of YbT gene |
| Se-YbT-R | TACGCCATGCAAATTCAGCGC (SEQ ID NO:51) | Amplification and sequence analysis of YbT gene |
| Se-ppi-F | AAAATCAAGCAGACGATGTAGGC (SEQ ID NO:52) | Amplification and sequence analysis of peptidylprolyl isomerase |
| Se-ppi-R | GTCTGACGGCCTAAGGAGTGAT (SEQ ID NO:53) | Amplification and sequence analysis of peptidylprolyl isomerase |

Fig. 6

| Amino acid | Mass |
|---|---|
| A | 71.079 |
| R | 156.188 |
| N | 114.103 |
| D | 115.088 |
| C | 103.145 |
| Q | 128.13 |
| E | 129.114 |
| G | 57.052 |
| H | 137.141 |
| I | 113.159 |
| L | 113.159 |
| K | 128.174 |
| M | 131.198 |
| F | 147.176 |
| P | 97.116 |
| S | 87.078 |
| T | 101.104 |
| W | 186.213 |
| Y | 163.175 |
| V | 99.132 |

| sample_name | % | family | genus | species |
|---|---|---|---|---|
| 01_NBRC13245T_Typhimurium | 99.9 | Family I Enterobacteriaceae | Salmonella | sp. |
| 02_GTC00131_Enteritidis | 99.9 | Family I Enterobacteriaceae | Salmonella | enterica subsp. enterica |
| 03_GTC09481_Enteritidis | 99.8 | Family I Enterobacteriaceae | Salmonella | enterica subsp. enterica |
| 04_GTC03830_Enteritidis | 87.9 | Family I Enterobacteriaceae | Salmonella | enterica subsp. enterica |
| 05_GTC06914_Enteritidis | 99.9 | Family I Enterobacteriaceae | Salmonella | enterica subsp. enterica |
| 06_GTC09421_Enteritidis | 99.9 | Family I Enterobacteriaceae | Salmonella | enterica subsp. enterica |
| 07_GTC09483_Enteritidis | 99.9 | Family I Enterobacteriaceae | Salmonella | enterica subsp. enterica |
| 08_NBRC3163_PullorumGallinarum | 97.6 | Family I Enterobacteriaceae | Salmonella | enterica subsp. enterica |
| 09_NBRC3313_Enteritidis | 99.9 | Family I Enterobacteriaceae | Salmonella | enterica subsp. enterica |
| 10_NBRC12529_Typhimurium | 99.9 | Family I Enterobacteriaceae | Salmonella | enterica subsp. enterica |
| 11_NBRC14193_Typhimurium | 99.9 | Family I Enterobacteriaceae | Salmonella | enterica subsp. enterica |
| 12_NBRC14194_Typhimurium | 99.9 | Family I Enterobacteriaceae | Salmonella | enterica subsp. enterica |
| 13_NBRC14209_Typhimurium | 99.9 | Family I Enterobacteriaceae | Salmonella | enterica subsp. enterica |
| 14_NBRC14210_Typhimurium | 99.9 | Family I Enterobacteriaceae | Salmonella | enterica subsp. enterica |
| 15_NBRC14211_Typhimurium | 85.4 | Family I Enterobacteriaceae | Salmonella | enterica subsp. enterica |
| 16_NBRC14212_Typhimurium | 99.9 | Family I Enterobacteriaceae | Salmonella | enterica subsp. enterica |
| 17_NBRC15181_Typhimurium | 99.9 | Family I Enterobacteriaceae | Salmonella | enterica subsp. enterica |
| 18_NBRC15182_Minnesota | 97.7 | Family I Enterobacteriaceae | Salmonella | enterica subsp. enterica |
| 19_NBRC15183_Minnesota | 94.9 | Family I Enterobacteriaceae | Salmonella | enterica subsp. enterica |
| 20_NBRC15184_Minnesota | 97.8 | Family I Enterobacteriaceae | Salmonella | enterica subsp. enterica |
| 21_NBRC15185_Minnesota | 99.9 | Family I Enterobacteriaceae | Salmonella | enterica subsp. enterica |
| 22_NBRC15186_Minnesota | 91.7 | Family I Enterobacteriaceae | Salmonella | enterica subsp. enterica |
| 23_NBRC15187_Minnesota | 99.9 | Family I Enterobacteriaceae | Salmonella | enterica subsp. enterica |
| 24_NBRC100797_Abony | 99.9 | Family I Enterobacteriaceae | Salmonella | enterica subsp. enterica |
| 25_NBRC105684_Choleraesuis | 99.9 | Family I Enterobacteriaceae | Salmonella | enterica subsp. enterica |
| 26_NBRC105726_Typhimurium | 99.9 | Family I Enterobacteriaceae | Salmonella | enterica subsp. enterica |
| 27_JCM3919_UN_O7 | 99.9 | Family I Enterobacteriaceae | Salmonella | enterica subsp. enterica |
| 28_NBRC15335_Minnesota | 99.9 | Family I Enterobacteriaceae | Salmonella | enterica subsp. enterica |
| 29_GTC09490_Enteritidis | 99.9 | Family I Enterobacteriaceae | Salmonella | enterica subsp. enterica |
| 30_GTC09492_Greenerup | 95 | Family I Enterobacteriaceae | Salmonella | enterica subsp. enterica |
| 31_GTC09493_Pakistan | 92 | Family I Enterobacteriaceae | Salmonella | enterica subsp. enterica |
| 32_GTC09549_Typhimurium | 97.4 | Family I Enterobacteriaceae | Salmonella | enterica subsp. enterica |
| 33-ATCCBAA-1675 | 99.9 | Family I Enterobacteriaceae | Salmonella | enterica subsp. enterica |
| 34-ATCCBAA-1738 | 99.9 | Family I Enterobacteriaceae | Salmonella | enterica subsp. enterica |
| 35-ATCC9712 | 99.9 | Family I Enterobacteriaceae | Salmonella | enterica subsp. enterica |
| 36_JfriSe1402-01 | 98.2 | Family I Enterobacteriaceae | Salmonella | enterica subsp. enterica |
| 38_JfriSe1402-03 | 99.8 | Family I Enterobacteriaceae | Salmonella | enterica subsp. enterica |
| 39_JfriSe1402-04 | 99.3 | Family I Enterobacteriaceae | Salmonella | enterica subsp. enterica |
| 40_JfriSe1402-05 | 99.8 | Family I Enterobacteriaceae | Salmonella | enterica subsp. enterica |
| 41_JfriSe1402-06 | 99.8 | Family I Enterobacteriaceae | Salmonella | enterica subsp. enterica |
| 42_JfriSe1402-07 | 99.9 | Family I Enterobacteriaceae | Salmonella | enterica subsp. enterica |
| 43_JfriSe1402-08 | 99.9 | Family I Enterobacteriaceae | Salmonella | enterica subsp. enterica |
| 44_JfriSe1402-09 | 99.9 | Family I Enterobacteriaceae | Salmonella | enterica subsp. enterica |
| 45_JfriSe1402-10 | 99.9 | Family I Enterobacteriaceae | Salmonella | enterica subsp. enterica |
| 46_JfriSe1402-11 | 99.9 | Family I Enterobacteriaceae | Salmonella | enterica subsp. enterica |
| 47_JfriSe1402-12 | 99.9 | Family I Enterobacteriaceae | Salmonella | enterica subsp. enterica |
| 48_JfriSe1402-13 | 99.9 | Family I Enterobacteriaceae | Salmonella | enterica subsp. enterica |
| 49_JfriSe1402-14 | 88.9 | Family I Enterobacteriaceae | Salmonella | enterica subsp. enterica |
| 50_JfriSe1402-15 | 99.9 | Family I Enterobacteriaceae | Salmonella | enterica subsp. enterica |
| 51_jfriSe1409-1_Altona | 99.9 | Family I Enterobacteriaceae | Salmonella | enterica subsp. enterica |
| 52_jfriSe1409-2_Istanbul | 99.8 | Family I Enterobacteriaceae | Salmonella | enterica subsp. enterica |
| 52_jfriSe1409-2_Istanbul | 97.7 | Family I Enterobacteriaceae | Salmonella | enterica subsp. enterica |
| 53_jfriSe1409-3_Senftenberg | 99.9 | Family I Enterobacteriaceae | Salmonella | enterica subsp. enterica |
| 54_jfriSe1409-4_UN_O13 | 97.3 | Family I Enterobacteriaceae | Salmonella | enterica subsp. enterica |
| 55_jfriSe1409-5_UN_O1_3_19 | 98.9 | Family I Enterobacteriaceae | Salmonella | enterica subsp. enterica |
| 56_jfriSe1409-6_Montevideo | 98.9 | Family I Enterobacteriaceae | Salmonella | enterica subsp. enterica |
| 57_jfriSe1409-7_UN_O1_3_19 | 99.9 | Family I Enterobacteriaceae | Salmonella | enterica subsp. enterica |
| 58_jfriSe1409-8_UN_O18 | 94.8 | Family I Enterobacteriaceae | Salmonella | enterica subsp. enterica |
| 59_jfriSe1409-9_Altona | 94.6 | Family I Enterobacteriaceae | Salmonella | enterica subsp. enterica |
| 60_jfriSe1409-10_Mbandaka | 97.6 | Family I Enterobacteriaceae | Salmonella | enterica subsp. enterica |

Fig. 10B

| | | | | |
|---|---|---|---|---|
| 61_jfrSe1409-11_UN_O1,3,19 | 99.9 | Family I Enterobacteriaceae | Salmonella | enterica subsp. enterica |
| 62_jfrSe1409-12_Montevideo | 99.9 | Family I Enterobacteriaceae | Salmonella | enterica subsp. enterica |
| 63_jfrSe1409-13_Rissen | 97.7 | Family I Enterobacteriaceae | Salmonella | enterica subsp. enterica |
| 64_jfrSe1409-14_Mbandaka | 99.9 | Family I Enterobacteriaceae | Salmonella | enterica subsp. enterica |
| 65_jfrSe1409-15_Rissen | 99.9 | Family I Enterobacteriaceae | Salmonella | enterica subsp. enterica |
| 66_jfrSe1409-16_Orion | 99.9 | Family I Enterobacteriaceae | Salmonella | enterica subsp. enterica |
| 67_jfrSe1409-17_UN_O7 | 91.7 | Family I Enterobacteriaceae | Salmonella | enterica subsp. enterica |
| 68_jfrSe1409-18_Thompson | 97.3 | Family I Enterobacteriaceae | Salmonella | enterica subsp. enterica |
| 69_jfrSe1409-19_Rissen | 99.9 | Family I Enterobacteriaceae | Salmonella | enterica subsp. enterica |
| 70_jfrSe1409-20_Mbandaka | 99.9 | Family I Enterobacteriaceae | Salmonella | enterica subsp. enterica |
| 71_jfrSe1409-21_Amsterdam | 99.9 | Family I Enterobacteriaceae | Salmonella | enterica subsp. enterica |
| 72_HySe01_Enteritidis_O9 | 99.9 | Family I Enterobacteriaceae | Salmonella | enterica subsp. enterica |
| 73_HySe02_Enteritidis_O9 | 99.9 | Family I Enterobacteriaceae | Salmonella | enterica subsp. enterica |
| 74_HySe03_Enteritidis_O9 | 99.9 | Family I Enterobacteriaceae | Salmonella | enterica subsp. enterica |
| 75_HySe04_Enteritidis_O9 | 99.9 | Family I Enterobacteriaceae | Salmonella | enterica subsp. enterica |
| 76_HySe05_Enteritidis_O9 | 99.9 | Family I Enterobacteriaceae | Salmonella | enterica subsp. enterica |
| 77_HySe06_Enteritidis_O9 | 99.9 | Family I Enterobacteriaceae | Salmonella | enterica subsp. enterica |
| 78_HySe07_Enteritidis_O9 | 99.9 | Family I Enterobacteriaceae | Salmonella | enterica subsp. enterica |
| 79_HySe08_Enteritidis_O9 | 99.9 | Family I Enterobacteriaceae | Salmonella | enterica subsp. enterica |
| 80_HySe09_Manhattan_O8 | 99.9 | Family I Enterobacteriaceae | Salmonella | enterica subsp. enterica |
| 81_HySe10_Infantis_O7 | 99.9 | Family I Enterobacteriaceae | Salmonella | enterica subsp. enterica |
| 82_HySe11_Thompson_O7 | 99.9 | Family I Enterobacteriaceae | Salmonella | enterica subsp. enterica |
| 83_HySe12_Saintpaul_O4 | 99.9 | Family I Enterobacteriaceae | Salmonella | enterica subsp. enterica |
| 84_HySe13_Infantis_O7 | 99.9 | Family I Enterobacteriaceae | Salmonella | enterica subsp. enterica |
| 85_HySe14_Enteritidis_O9 | 99.9 | Family I Enterobacteriaceae | Salmonella | enterica subsp. enterica |
| 86_HySe15_Infantis_O7 | 99.9 | Family I Enterobacteriaceae | Salmonella | enterica subsp. enterica |
| 87_HySe16_Enteritidis_O9 | 99.9 | Family I Enterobacteriaceae | Salmonella | enterica subsp. enterica |
| 88_HySe17_Enteritidis_O9 | 99.9 | Family I Enterobacteriaceae | Salmonella | enterica subsp. enterica |
| 89_HySe18_Enteritidis_O9 | 99.9 | Family I Enterobacteriaceae | Salmonella | enterica subsp. enterica |
| 90_HySe19_Enteritidis_O9 | 99.9 | Family I Enterobacteriaceae | Salmonella | enterica subsp. enterica |
| 91_HySe20_Enteritidis_O9 | 99.9 | Family I Enterobacteriaceae | Salmonella | enterica subsp. enterica |
| 92_HySe21_Enteritidis_O9 | 99.9 | Family I Enterobacteriaceae | Salmonella | enterica subsp. enterica |
| 93_HySe22_Enteritidis_O9 | 99.9 | Family I Enterobacteriaceae | Salmonella | enterica subsp. enterica |
| 94_HySe23_Enteritidis_O9 | 99.9 | Family I Enterobacteriaceae | Salmonella | enterica subsp. enterica |
| 95_HySe24_Enteritidis_O9 | 99.9 | Family I Enterobacteriaceae | Salmonella | enterica subsp. enterica |
| 96_HySe25_Enteritidis_O9 | 99.9 | Family I Enterobacteriaceae | Salmonella | enterica subsp. enterica |
| 97_HySe26_Enteritidis_O9 | 99.9 | Family I Enterobacteriaceae | Salmonella | enterica subsp. enterica |
| 98_HySe27_Enteritidis_O9 | 99.9 | Family I Enterobacteriaceae | Salmonella | enterica subsp. enterica |
| 99_HySe28_Enteritidis_O9 | 99.9 | Family I Enterobacteriaceae | Salmonella | enterica subsp. enterica |
| 100_HySe29_Schwarzengrund_O4 | 99.9 | Family I Enterobacteriaceae | Salmonella | enterica subsp. enterica |
| 101_HySe30_Typhimurium_O4 | 99.9 | Family I Enterobacteriaceae | Salmonella | enterica subsp. enterica |
| 102_HySe31_Thompson_O7 | 99.9 | Family I Enterobacteriaceae | Salmonella | enterica subsp. enterica |
| 103_HySe32_Schwarzengrund_O4 | 99.9 | Family I Enterobacteriaceae | Salmonella | enterica subsp. enterica |
| 104_HySe33_Saintpaul_O4 | 99.9 | Family I Enterobacteriaceae | Salmonella | enterica subsp. enterica |
| 105_HySe34_Thompson_O7 | 99.9 | Family I Enterobacteriaceae | Salmonella | enterica subsp. enterica |
| 106_HySe35_Schwarzengrund_O4 | 99.9 | Family I Enterobacteriaceae | Salmonella | enterica subsp. enterica |
| 107_HySe36_Enteritidis_O9 | 99.9 | Family I Enterobacteriaceae | Salmonella | enterica subsp. enterica |
| 108_HySe37_Enteritidis_O9 | 99.9 | Family I Enterobacteriaceae | Salmonella | enterica subsp. enterica |
| 109_HySe38_Enteritidis_O9 | 99.9 | Family I Enterobacteriaceae | Salmonella | enterica subsp. enterica |
| 110_HySe39_Enteritidis_O9 | 99.9 | Family I Enterobacteriaceae | Salmonella | enterica subsp. enterica |
| 111_HySe40_Enteritidis_O9 | 99.9 | Family I Enterobacteriaceae | Salmonella | enterica subsp. enterica |
| 112_jfrSe1507-01_Typhimurium | 99.9 | Family I Enterobacteriaceae | Salmonella | enterica subsp. enterica |
| 113_jfrSe1507-02_Schwarzengrund | 99.9 | Family I Enterobacteriaceae | Salmonella | enterica subsp. enterica |
| 114_jfrSe1507-03_Schwarzengrund | 99.9 | Family I Enterobacteriaceae | Salmonella | enterica subsp. enterica |
| 115_jfrSe1507-04_UN_O4 | 99.9 | Family I Enterobacteriaceae | Salmonella | enterica subsp. enterica |
| 116_jfrSe1507-05_UN_O4 | 97.3 | Family I Enterobacteriaceae | Salmonella | enterica subsp. enterica |
| 117_jfrSe1507-06_UN_O4 | 99.9 | Family I Enterobacteriaceae | Salmonella | enterica subsp. enterica |

Fig. 24A

| | S8 |
|---|---|
| 01_NBRC13245T_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 54) |
| 02_GTC00131_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 66) |
| 03_GTC09491_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 75) |
| 04_GTC03838_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 82) |
| 05_GTC08914_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 89) |
| 06_GTC09421_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 99) |
| 07_GTC09489_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 109) |
| 08_NBRC3163_Pullorum_Gallinarum | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 116) |
| 09_NBRC3313_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 126) |
| 10_NBRC12529_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 133) |
| 11_NBRC14193_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 140) |
| 12_NBRC14194_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 147) |
| 13_NBRC14209_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 154) |
| 14_NBRC14210_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 161) |
| 15_NBRC14211_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 168) |
| 16_NBRC14212_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 174) |

Fig. 24B

| | |
|---|---|
| 17_NBRC15181_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 181) |
| 18_NBRC15182_Minnesota | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 191) |
| 19_NBRC15183_Minnesota | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 201) |
| 20_NBRC15184_Minnesota | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 208) |
| 21_NBRC15185_Minnesota | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 215) |
| 22_NBRC15186_Minnesota | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 222) |
| 23_NBRC15187_Minnesota | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 229) |
| 24_NBRC100797_Abony | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 236) |
| 25_NBRC105684_Choleraesuis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 246) |
| 26_NBRC105726_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 256) |
| 27_JCM3919_UN_O7_ | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 265) |
| 28_NBRC15335_Minnesota | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 272) |
| 29_GTC09490_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 279) |
| 30_GTC09492_Braenderup | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 286) |
| 31_GTC09493_Pakistan | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 293) |
| 32_GTC09549_Typhimurium | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 300) |
| 33_ATCCBAA-1675_Infantis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 307) |
| 34_ATCCBAA-1738_Thompson | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 318) |
| 35_ATCC9712_Saintpaul | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 328) |

Fig. 24C

| | |
|---|---|
| 36_jfrlSe1402-1_Infantis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 339) |
| 38_jfrlSe1402-3_Brandenburg | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 349) |
| 39_jfrlSe1402-4_Infantis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 356) |
| 40_jfrlSe1402-5_Brandenburg | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 366) |
| 41_jfrlSe1402-6_Rissen | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGATTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 373) |
| 42_jfrlSe1402-7_Orion | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 380) |
| 43_jfrlSe1402-8_Rissen | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGATTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 390) |
| 44_jfrlSe1402-9_Rissen | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGATTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 397) |
| 45_jfrlSe1402-10_Rissen | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGATTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 404) |
| 46_jfrlSe1402-11_Rissen | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGATTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 411) |
| 47_jfrlSe1402-12_Rissen | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGATTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 418) |
| 48_jfrlSe1402-13_Mbandaka | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGCAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 425) |
| 49_jfrlSe1402-14_Mbandaka | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGCAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 435) |
| 50_jfrlSe1402-15_Orion | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 445) |
| 51_jfrlSe1409-1_Altona | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 455) |
| 52_jfrlSe1409-2_Istanbul | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAAGGTTTTATTGAAGATTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGCCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 462) |
| 53_jfrlSe1409-3_Senftenberg | |

Fig. 24D

| | |
|---|---|
| 54_jfrlSe1409-4_UN_O13_ | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 475) |
| 55_jfrlSe1409-5_UN_O1,3,19_ | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 483) |
| 56_jfrlSe1409-6_Montevideo | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGCCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 492) |
| 57_jfrlSe1409-7_UN_O1,3,19_ | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 499) |
| 58_jfrlSe1409-8_UN_O18_ | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 508) |
| 61_jfrlSe1409-11_UN_O1,3,19_ | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 517) |
| 67_jfrlSe1409-17_Rissen | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGATTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 526) |
| 71_jfrlSe1409-21_Amsterdam | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGCCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 534) |
| 80_HySe09_Enteritidis | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 544) |
| 100_HySe29_Schwarzengrund | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 554) |
| 103_HySe32_Schwarzengrund | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 562) |
| 106_HySe35_Schwarzengrund | ATGAGCATGCAAGATCCGATCGCGGATATGCTGACCCGTATCCGTAACGGTCAGGCCGCGAACAAAGCTGCGGTCACCATGCC<br>TTCCTCCAAGCTGAAAGTGGCAATTGCCAACGTGCTGAAGGAAGAAGGTTTTATTGAAGATTTTAAAGTTGAAGGCGACACCAA<br>GCCGGAACTGGAACTGACTCTTAAGTATTTCCAGGGTAAAGCTGTTGTAGAAAGCATTCAGCGTGTCAGCCGCCCAGGTCTGC<br>GCATCTACAAACGTAAAGATGAGCTGCCGAAAGTTATGGCCGGTCTGGGTATCGCAGTTGTTTCTACCTCTAAAGGTGTTATGA<br>CTGATCGTGCAGCGCGCCAGGCTGGTCTTGGTGGCGAAATTATCTGCTACGTAGCCTAA (SEQ ID NO: 569) |

Fig. 25A

| | L15 |
|---|---|
| 01_NBRC13245T_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 55) |
| 02_GTC00131_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 67) |
| 03_GTC09491_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 76) |
| 04_GTC03838_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 83) |
| 05_GTC08914_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 90) |
| 06_GTC09421_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 100) |
| 07_GTC09489_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 110) |
| 08_NBRC3163_Pullorum_Gallinarum | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 117) |
| 09_NBRC3313_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 127) |
| 10_NBRC12529_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 134) |
| 11_NBRC14193_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 141) |
| 12_NBRC14194_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 148) |
| 13_NBRC14209_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 155) |
| 14_NBRC14210_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 162) |
| 15_NBRC14211_Typhimurium | |
| 16_NBRC14212_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 175) |
| 17_NBRC15181_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 182) |

Fig. 25B

| | |
|---|---|
| 18_NBRC15182_Minnesota | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 192) |
| 19_NBRC15183_Minnesota | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 202) |
| 20_NBRC15184_Minnesota | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 209) |
| 21_NBRC15185_Minnesota | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 216) |
| 22_NBRC15186_Minnesota | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 223) |
| 23_NBRC15187_Minnesota | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 230) |
| 24_NBRC100797_Abony | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 237) |
| 25_NBRC105684_Choleraesuis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 247) |
| 26_NBRC105726_Typhimurium | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTATTCGTGGCCTGCGTGTTACTAAAGGCGCTCGTGCTGCTATCGAAGCTGCTGG<br>CGGTAAAATCGAGGAATAA (SEQ ID NO: 257) |
| 27_JCM3919_UN_O7_ | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 266) |
| 28_NBRC15335_Minnesota | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 273) |
| 29_GTC09490_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACTTGGCGA<br>AAGTAGAAGGCGGCGTTGTAGACCTGAACACGCTGAAAGCGGGCAAACATTATCGGTATCCAGATCGAGTTCGCGAAAGTGATCT<br>TGGCTGGCGAAGTCACTACTCCGGTAACTGTTCGTGGCCTGCGTGTTACTAAAGGCGCTCGTGCTGCTATCGAAGCTGCTGGC<br>GGTAAAATCGAGGAATAA (SEQ ID NO: 280) |
| 30_GTC09492_Braenderup | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 287) |
| 31_GTC09493_Pakistan | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCTGTCTGACCTGGCG<br>AAAGTAGAAGGCGGCGTTGTAGACCTGAACACGCTGAAAGCGGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 294) |

Fig. 25C

| | |
|---|---|
| 32_GTC09549_Typhimurium | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 301) |
| 33_ATCCBAA-1675_Infantis | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 308) |
| 34_ATCCBAA-1738_Thompson | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 319) |
| 35_ATCC9712_Saintpaul | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGTGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 329) |
| 36_jfrlSe1402-1_Infantis | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 340) |
| 38_jfrlSe1402-3_Brandenburg | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 350) |
| 39_jfrlSe1402-4_Infantis | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 357) |
| 40_jfrlSe1402-5_Brandenburg | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 367) |
| 41_jfrlSe1402-6_Rissen | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 374) |
| 42_jfrlSe1402-7_Orion | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 381) |
| 43_jfrlSe1402-8_Rissen | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 391) |
| 44_jfrlSe1402-9_Rissen | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 398) |
| 45_jfrlSe1402-10_Rissen | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 405) |
| 46_jfrlSe1402-11_Rissen | ATGCGTTTAAATACTCTGTCTCCGGCCGAAGGCTCCAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 412) |

Fig. 25D

| | |
|---|---|
| 47_jfrlSe1402-12_Rissen | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 419) |
| 48_jfrlSe1402-13_Mbandaka | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 426) |
| 49_jfrlSe1402-14_Mbandaka | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 436) |
| 50_jfrlSe1402-15_Orion | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 446) |
| 51_jfrlSe1409-1_Altona | ATGCATTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATTCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 456) |
| 52_jfrlSe1409-2_Istanbul | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 463) |
| 53_jfrlSe1409-3_Senftenberg | |
| 54_jfrlSe1409-4_UN_O13_ | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 476) |
| 55_jfrlSe1409-5_UN_O1,3,19_ | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 484) |
| 56_jfrlSe1409-6_Montevideo | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 493) |
| 57_jfrlSe1409-7_UN_O1,3,19_ | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 500) |
| 58_jfrlSe1409-8_UN_O18_ | ATGCGTTTAAATACTCTGTCTCCGGCCGAAGGCTCCAAAAAGGCGGGTAAACGCCTGGGTCGTGGTATCGGTTCTGGCCTCGG TAAAACCGGTGGTCGTGGTCACAAAGGTCAGAAGTCTCGTTCTGGCGGTGGCGTACGTCGCGGTTTCGAGGGTGGTCAGATGC CTCTGTACCGTCGTCTGCCGAAATTCGGCTTCACTTCTCGCAAAGCAGCGATTACAGCCGAAGTTCGTCGTCTGACCTGGCG AAAGTAGAAGGCGGCGTTGTAGACCTGAACACGCTGAAAGCGGGCAAACATTATCGGTATCCAGATCGAGTTCGCGAAAGTGATC CTGGCTGGCGAAGTCACTACTCCGGTAACTGTTCGTGGCCTGCGTGTTACTAAAGGCGCTCGTGCTGCTATCGAAGCTGCTGG CGGTAAAATCGAGGAATAA (SEQ ID NO: 509) |

Fig. 25E

| | |
|---|---|
| 61_jfrlSe1409-11_UN_O1,3,19_ | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 518) |
| 67_jfrlSe1409-17_Rissen | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 527) |
| 71_jfrlSe1409-21_Amsterdam | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 535) |
| 80_HySe09_Enteritidis | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 545) |
| 100_HySe29_Schwarzengrund | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 555) |
| 103_HySe32_Schwarzengrund | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 563) |
| 106_HySe35_Schwarzengrund | ATGCGTTTAAATACTCTGTCTCCGGCCGAAGGCTCCAAAAAGGCGGGTAAACGCCTGGGTCGTGGTATCGGTTCTGGCCTCGG<br>TAAAACCGGTGGTCGTGGTCACAAAGGTCAGAAGTCTCGTTCTGGCGGTGGCGTACGTCGCGGTTTCGAGGGTGGTCAGATGC<br>CTCTGTACCGTCGTCTGCCGAAATTCGGCTTCACTTCTCGCAAAGCAGCGATTACAGCCGAAGTTCGTCGTCTGACCTGGCG<br>AAAGTAGAAGGCGGCGTTGTAGACCTGAACACGCTGAAAGCGGCAAACATTATCGGTATCCAGATCGAGTTCGCGAAAGTGATC<br>CTGGCTGGCGAAGTCACTACTCCGGTAACTGTTCGTGGCCTGCGTGTTACTAAAGGCGCTCGTGCTGCTATCGAAGCTGCTGG<br>CGGTAAAATCGAGGAATAA (SEQ ID NO: 570) |

Fig. 26A

| | L17 |
|---|---|
| 01_NBRC13245T_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 56) |
| 02_GTC00131_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 68) |
| 03_GTC09491_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 77) |
| 04_GTC03838_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 84) |
| 05_GTC08914_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 91) |
| 06_GTC09421_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 101) |
| 07_GTC09489_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 111) |
| 08_NBRC3163_Pullorum_Gallinarum | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGATCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGCTCAGAGAAAACAGAAGCTGCTGCAGAGTAA (SEQ ID NO: 118) |

Fig. 26B

| | |
|---|---|
| 09_NBRC3313_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 128) |
| 10_NBRC12529_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 135) |
| 11_NBRC14193_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 142) |
| 12_NBRC14194_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 149) |
| 13_NBRC14209_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 156) |
| 14_NBRC14210_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 163) |
| 15_NBRC14211_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 169) |
| 16_NBRC14212_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 176) |
| 17_NBRC15181_Typhimurium | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 183) |
| 18_NBRC15182_Minnesota | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 193) |
| 19_NBRC15183_Minnesota | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 203) |
| 20_NBRC15184_Minnesota | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 210) |
| 21_NBRC15185_Minnesota | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 217) |
| 22_NBRC15186_Minnesota | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 224) |
| 23_NBRC15187_Minnesota | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 231) |
| 24_NBRC100797_Abony | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 238) |
| 25_NBRC105684_Choleraesuis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 248) |

Fig. 26C

| | |
|---|---|
| 26_NBRC105726_Typhimurium | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 258) |
| 27_JCM3919_UN_O7_ | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 267) |
| 28_NBRC15335_Minnesota | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 274) |
| 29_GTC09490_Enteritidis | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 281) |
| 30_GTC09492_Braenderup | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 288) |
| 31_GTC09493_Pakistan | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 295) |
| 32_GTC09549_Typhimurium | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 302) |
| 33_ATCCBAA-1675_Infantis | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 309) |
| 34_ATCCBAA-1738_Thompson | ATGCGCCATCGTAAGAGTGGTCGTCAACTGAACCGCAACAGCAGCCATCGCCAGGCTATGTTCCGCAATATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 320) |
| 35_ATCC9712_Saintpaul | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 330) |
| 36_jfrlSe1402-1_Infantis | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 341) |
| 38_jfrlSe1402-3_Brandenburg | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 351) |
| 39_jfrlSe1402-4_Infantis | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 358) |
| 40_jfrlSe1402-5_Brandenburg | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 368) |
| 41_jfrlSe1402-6_Rissen | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 375) |
| 42_jfrlSe1402-7_Orion | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 382) |
| 43_jfrlSe1402-8_Rissen | ATGCGCCATCGTAAGAGTGGTCGTCAACTGAACCGCAACAGCAGCCATCGCCAGGCTATGTTCCGCAACATGGCAGGTTCACT GGTTCGTCATGAAATCATCAAGACGACCCTGCCTAAAGCGAAAGAGCTGCGTCGCGTAGTTGAGCCGCTGATTACTCTTGCCA AGACTGATAGCGTTGCTAATCGTCGTCTGGCATTCGCCCGTACTCGTGATAACGAGATCGTGGCAAAACTGTTTAACGAGCTG GGCCCGCGTTTCGCGAGCCGCGCCGGTGGTTACACTCGCATTCTGAAGTGTGGCTTCCGTGCAGGCGACAACGCGCCGATGG CATACATCGAGCTGGTTGATCGTTCAGAGAAAACAGAAGCTGCTGCAGAGTAA (SEQ ID NO: 392) |

Fig. 26D

| | |
|---|---|
| 44_jfrlSe1402-9_Rissen | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 399) |
| 45_jfrlSe1402-10_Rissen | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 406) |
| 46_jfrlSe1402-11_Rissen | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 413) |
| 47_jfrlSe1402-12_Rissen | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 420) |
| 48_jfrlSe1402-13_Mbandaka | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 427) |
| 49_jfrlSe1402-14_Mbandaka | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 437) |
| 50_jfrlSe1402-15_Orion | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 447) |
| 51_jfrlSe1409-1_Altona | |
| 52_jfrlSe1409-2_Istanbul | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 464) |
| 53_jfrlSe1409-3_Senftenberg | |
| 54_jfrlSe1409-4_UN_O13_ | |
| 55_jfrlSe1409-5_UN_O1,3,19_ | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 485) |
| 56_jfrlSe1409-6_Montevideo | |
| 57_jfrlSe1409-7_UN_O1,3,19_ | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 501) |
| 58_jfrlSe1409-8_UN_O18_ | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 510) |
| 61_jfrlSe1409-11_UN_O1,3,19_ | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 519) |
| 67_jfrlSe1409-17_Rissen | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 528) |
| 71_jfrlSe1409-21_Amsterdam | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 536) |
| 80_HySe09_Enteritidis | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 546) |

Fig. 26E

| | |
|---|---|
| 100_HySe29_Schwarzengrund | GTGAAAGAAGAGAAACCAGAATTCGATCCGATCTGCTGCGCCTGTTGACGATCTGGAATTTACTGGTCCGCTCTGCTAACTGC<br>CTCAAGGCAGAAGCTATCCACTATATCGGTGATCTGGTACAGCGTACCGAGGTTGAGCTTCTTAAGACGCCTAACCTGGGTAA<br>AAAATCTCTTACCGAGATTAAAGACGTGCTGGCTTCCCGTGGACTGTCTCTGGGTATGCGCGTGGAAAACTGGCCACCGGCAA<br>GCATCGCTGACGAGTAACCGGATCACAGGTTAAGGTTTTACTGAGAAGGATAAGGTCATGCGCCATCGTAAGAGTGGTCGTCA<br>ACTGAACCGCAACAGCAGCCATCGCCAGGCTATGTTCCGCAACATGGCAGGTTCACTGGTTCGTCATGAAATCATCAAGACGA<br>CCCTGCCTAAAGCGAAAGAGCTGCGTCGCGTAGTTGAGCCGCTGATTACTCTTGCCAAGACTGATAGCGTTGCTAATCGTCGT<br>CTGGCATTCGCCCGTACTCGTGATAACGAGATCGTGGCAAAACTGTTTAACGAGCTGGGGCCCGCGTTTCGCGAGCCGCGCCG<br>GTGGTTACACTCGCATTCTGAAGTGTGGCTTCCGTGCAGGCGACAACGCGCCGATGGCATACATCGAGCTGGTTGATCGTTCA<br>GAGAAAACAGAAGCTGCTGCAGAGTAATCTGTAGTAACGTAAAAAAACCCGCTTCGGCGGGTTTTTTATACCCTCCTGAACCC<br>CATGTATCTACAATAATTGTATTCTTTTCGTT (SEQ ID NO: 556) |
| 103_HySe32_Schwarzengrund | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 564) |
| 106_HySe35_Schwarzengrund | ATGCGCCATCGTAAGAGTGGTCGTCAACTGAACCGCAACAGCAGCCATCGCCAGGCTATGTTCCGCAACATGGCAGGTTCACT<br>GGTTCGTCATGAAATCATCAAGACGACCCTGCCTAAAGCGAAAGAGCTGCGTCGCGTAGTTGAGCCGCTGATTACTCTTGCCA<br>AGACTGATAGCGTTGCTAATCGTCGTCTGGCATTCGCCCGTACTCGTGATAACGAGATCGTGGCAAAACTGTTTAACGAGCTG<br>GGGCCCGCGTTTCGCGAGCCGCGCCGGTGGTTACACTCGCATTCTGAAGTGTGGCTTCCGTGCAGGCGACAACGCGCCGATGG<br>CATACATCGAGCTGGTTGATCGTTCAGAGAAAACAGAAGCTGCTGCAGAGTAA (SEQ ID NO: 571) |

Fig. 27A

| | sodA |
|---|---|
| 01_NBRC13245T_Typhimurium | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCCAGCCTGCCGGTTGAAG<br>AACTCGATTACTAAACTGGACCAGGTGCCAGCGGACAAAAAAACCTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 57) |
| 02_GTC00131_Enteritidis | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAAGGCACCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 69) |
| 03_GTC09491_Enteritidis | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAAGGCACCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 78) |
| 04_GTC03838_Enteritidis | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAAGGCACCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 85) |
| 05_GTC08914_Enteritidis | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAAGGCACCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 92) |
| 06_GTC09421_Enteritidis | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAAGGCACCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 102) |
| 07_GTC09489_Enteritidis | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAAGGCACCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 112) |

Fig. 27B

| | |
|---|---|
| 08_NBRC3163_Pullorum_Gallinarum | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAACCGTGCTGCGTAATAACGCGGGCGGCCACGCTAACCACAGC<br>TTCTTCTGGAAAGGCCTGAAAAAGGCACCCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 119) |
| 09_NBRC3313_Enteritidis | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAGGCACCCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 129) |
| 10_NBRC12529_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 136) |
| 11_NBRC14193_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 143) |
| 12_NBRC14194_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 150) |
| 13_NBRC14209_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 157) |
| 14_NBRC14210_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 164) |
| 15_NBRC14211_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 170) |
| 16_NBRC14212_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 177) |
| 17_NBRC15181_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 184) |

Fig. 27C

| | |
|---|---|
| 18_NBRC15182_Minnesota | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTTCCGATCCT<br>GGGTCTGGACGTGTGGGAACACGCTTACTATCTGAAATTCCAAAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 194) |
| 19_NBRC15183_Minnesota | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTTCCGATCCT<br>GGGTCTGGACGTGTGGGAACACGCTTACTATCTGAAATTCCAAAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 204) |
| 20_NBRC15184_Minnesota | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTTCCGATCCT<br>GGGTCTGGACGTGTGGGAACACGCTTACTATCTGAAATTCCAAAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 211) |
| 21_NBRC15185_Minnesota | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTTCCGATCCT<br>GGGTCTGGACGTGTGGGAACACGCTTACTATCTGAAATTCCAAAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 218) |
| 22_NBRC15186_Minnesota | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTTCCGATCCT<br>GGGTCTGGACGTGTGGGAACACGCTTACTATCTGAAATTCCAAAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 225) |
| 23_NBRC15187_Minnesota | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTTCCGATCCT<br>GGGTCTGGACGTGTGGGAACACGCTTACTATCTGAAATTCCAAAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 232) |
| 24_NBRC100797_Abony | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTGGATCAGGTGCCAGCGGACAAAAAAACCGTGCTGCGTAACAACGCTGGCGGCCATGCTAACCACAGC<br>TTCTTCTGGAAGGGCTGAAAAAAGGCACCACCCTGCAGGGTGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTATCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 239) |
| 25_NBRC105684_Choleraesuis | ATGAGTTATACACTGCCATCCCTGCCGTACGCTTATGATGCACTGGAACCGCACTTCGATAAGCAGACGATGGCGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGATCAGGTGCCAGCGGACAAAAAAACCGTACTGCGTAACAACGCGGGCGGCCACGCTAACCACAGC<br>CTGTTCTGGAAAGGGCTGAAAAAAGGCACCACTCTGCAGGGCGATCTGAAACGGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 249) |
| 26_NBRC105726_Typhimurium | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAACGGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 259) |
| 27_JCM3919_UN_O7_ | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGATCAGGTGCCAGCGGACAAAAAAACCGTGCTGCGTAACAACGCGGGCGGCCACGCTAACCACAGC<br>CTGTTCTGGAAAGGGCTGAAAAAAGGCACCACTCTGCAGGGCGATCTGAAACGGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTTTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 268) |

Fig. 27D

| | |
|---|---|
| 28_NBRC15335_Minnesota | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCGATCCT<br>GGGTCTGGACGTGTGGGAACACGCTTACTATCTGAAATTCCAAAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 275) |
| 29_GTC09490_Enteritidis | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAATAACGCGGGCGGCCACGCTAACCACAGC<br>TTCTTCTGGAAAGGCCTGAAAAAAGGCACCACCCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 282) |
| 30_GTC09492_Braenderup | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCGTTTCCGGCGCTTCCGGCTTCCCGATCCT<br>GGGCCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 289) |
| 31_GTC09493_Pakistan | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACTTGCCAGAGTTTGCTGACCTGCCGGTTGAAG<br>AACTGATTACTAAACTGGACCAGGTGCCAGCGGACAAAAAAACCGTGCTGCGTAACAACGCGGGCGGCCACGCTAACCACAG<br>CTTCTTCTGGAAGGGCTGAAAAAAGGCTCACCCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 296) |
| 32_GTC09549_Typhimurium | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAACCTGTGCTGCGTAACAACGCGGGCGGCCATGCTAACCACAGC<br>CTGTTCTGGAAAGGGCTGAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 303) |
| 33_ATCCBAA-1675_Infantis | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 310) |
| 34_ATCCBAA-1738_Thompson | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCTGACCTGCCGGTTGAAG<br>AACTGATTACTGGATCAGGTGCCAGCGGACAAAAAACCGTGCTGCGTAACAACGCGGGCGGCCACGCTAACCACAGC<br>CTGTTCTGGAAAGGGCTGAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTATCTGAAATTCCAGAACCGCCGCCCGGACTACATCAAAGAGTTCTGGAACGTGGTG<br>AACTGGGACGAAGCAGCAGCGCGTTTCGCCGCGTAAAAAATAA (SEQ ID NO: 321) |
| 35_ATCC9712_Saintpaul | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCCAGCCTGCCGGTTGAAG<br>AACTGATTACTAAACTGGACCAGGTGCCAGCGGACAAAAAAACCGTGCTGCGTAACAACGCGGGCGGCCATGCTAACCACAGC<br>CTGTTCTGGAAAGGGCTGAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 331) |
| 36_jfrlSe1402-1_Infantis | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAGGCACCACTCTGCAGGGCGATCTGAAAGCGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGTGCTTCCGGCTTCCCGATCCTGG<br>GTCTGGACGTGTGGGAACACGCTTACTATCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 342) |
| 38_jfrlSe1402-3_Brandenburg | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 352) |

Fig. 27E

| | |
|---|---|
| 39_jfrlSe1402-4_Infantis | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTATCTGAAATTCCAGAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 359) |
| 40_jfrlSe1402-5_Brandenburg | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 369) |
| 41_jfrlSe1402-6_Rissen | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGTGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGTGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 376) |
| 42_jfrlSe1402-7_Orion | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 383) |
| 43_jfrlSe1402-8_Rissen | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGTGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGTGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 393) |
| 44_jfrlSe1402-9_Rissen | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGTGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGTGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 400) |
| 45_jfrlSe1402-10_Rissen | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGTGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGTGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 407) |
| 46_jfrlSe1402-11_Rissen | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGTGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGTGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 414) |
| 47_jfrlSe1402-12_Rissen | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGTGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGTGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 421) |
| 48_jfrlSe1402-13_Mbandaka | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCGGGCGGCCACGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 428) |

Fig. 27F

| | |
|---|---|
| 49_jfrlSe1402-14_Mbandaka | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGATCAGGTGCCAGCGGACAAAAAAACCGTGCTGCGTAACAACGCGGGCGGCCACGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 438) |
| 50_jfrlSe1402-15_Orion | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCCAGCCTGCCGGTTGAAG<br>AACTGATTACTAAACTGGACCAGGTGCCAGCGGACAAAAAAACTGTGCTGCGTAACAACGCGGGCGGCCATGCTAACCACAGC<br>CTGTTCTGGAAAGGGCTGAAAAAAGGCACCACTCTGCAGGGCGATCTGAAAGCGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACATCAAAGAGTTCTGGAACGTGGT<br>GAACTGGGACGAAGCAGCAGCGCGTTTCGCCGCTAAAAAATAA (SEQ ID NO: 448) |
| 51_jfrlSe1409-1_Altona | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGATCAGGTGCCAGCGGACAAAAAAACCGTGCTGCGTAACAACGCGGGCGGCCACGCTAACCACAGC<br>CTGTTCTGGAAAGGGCTGAAAAAAGGCACCACTCTGCAGGGCGATCTGAAACGGCTATCGAGCGTGACTTCGGTTCCGTTGA<br>CAACTTCAAAGCTGAATTCGAAAAAGCAGCAGCAACCCGTTTCGGCTCCGGCTGGGCGTGGCTGGTGCTGAAAGGCGACAAA<br>CTGGCTGTGGTTTCTACCGCAAACCAGGATTCCCCGCTGATGGGTGAAGCCATTTCCGGCGCTTCCGGCTTCCCGATCCTGG<br>GCCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 457) |
| 52_jfrlSe1409-2_Istanbul | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTATGGGAACACGCTTACTATCTGAAATTCCAGAACCGCCGCCCGGACTACATCAAAGAGTTCTGGAACGTGG<br>TGAACTGGGACGAAGCAGCAGCGCGTTTCGCCGCTAAAAAATAA (SEQ ID NO: 465) |
| 53_jfrlSe1409-3_Senftenberg | |
| 54_jfrlSe1409-4_UN_O13_ | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 477) |
| 55_jfrlSe1409-5_UN_O1,3,19_ | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 486) |
| 56_jfrlSe1409-6_Montevideo | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCGGCGCTGGAAAAACCTGCCTGAGTTTGCTGACCTGCCGGTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 494) |
| 57_jfrlSe1409-7_UN_O1,3,19_ | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCGGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 502) |
| 58_jfrlSe1409-8_UN_O18_ | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCCAGCCTGCCGGTTGAAG<br>AACTGATTACTAAACTGGACCAGGTGCCAGCGGACAAAAAAACCGTGCTGCGTAACAACGCGGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGTTCCGGCTGGGCGTGGCTGGTGCTGAAAGGTGACAA<br>ACTGGCTGTGGTTTCTACCGCAAACCAGGATTCCCCGCTGATGGGTGAAGCCATTTCCGGCGCTTCCGGCTTCCCGATCCTG<br>GGTCTGGACGTGTGGGAACACGCTTACTACCTGAAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 511) |
| 61_jfrlSe1409-11_UN_O1,3,19_ | ATGAGTTATACACTGCCATCCCTGCCGTACGCTTATGATGCACTGGAACCGCACTTCGATAAGCAGACGATGGAGATTCACCA<br>CACCCAAACACCATCAAACCTATGTCAACAACGCTAACGCGGCGCTGGAAAAACCTGCCTGAGTTTGCTGACCTGCCGGTTGAAG<br>AACTGATTACTAAACTGGACCAGGTGCCAGCGGACAAAAAAACCGTGCTGCGTAACAACGCGGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 520) |

Fig. 27G

| | |
|---|---|
| 67_jfrlSe1409-17_Rissen | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGTGGCTATCGAGCGTGACTTCGGTTCCGTTG<br>ACAACTTCAAAGCTGAATTCGAAAAAGCAGCAGCAACCCGTTTCGGCTCCGGCTGGGCGTGGCTGGTGCTGAAAGGTGACAA<br>CTGGCTGTGGTTTCTACCGCAAACCAGGATTCCCCGCTGATGGGTGAAGCCATTTCCGGCGCTTCCGGCTTCCCGATCCTGG<br>GTCTGGACGTGTGGGAACACGCTTACTACCTGAATTCCAGAACCGCCGCCCGGACTACATCAAAGAGTTCTGGAACGTGGTG<br>AACTGGGACGAAGCAGCAGCGCGTTTCGCCGCTAAAAAATAA (SEQ ID NO: 529) |
| 71_jfrlSe1409-21_Amsterdam | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGTGACAA<br>ACTGGCTGTGGTTTCTACCGCAAACCAGGATTCTCCGCTGATGGGTGAAGCCATTTCCGGCGCTTCCGGCTTCCCGATCCTG<br>GGTCTGGACGTGTGGGAACACGCTTACTACCTGAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 537) |
| 80_HySe09_Enteritidis | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGTTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGATCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGATAA<br>ACTGGCTGTGGTTTCTACCGCTAACCAGGATTCCCCGCTGATGGGTGAAGCCATTTCCGGCGCTTCCGGCTTCCCGATCCTG<br>GGTCTGGACGTGTGGGAACACGCTTACTATCTGAATTCCAGAACCGCCGCCCGGACTACATCAAAGAGTTCTGGAACGTGGT<br>GAACTGGGACGAAGCAGCAGCGCGTTTCGCCGCTAAAAAATAA (SEQ ID NO: 547) |
| 100_HySe29_Schwarzengrund | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGCTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 557) |
| 103_HySe32_Schwarzengrund | ATGAGTTATACACTGCCATCCCTGCCGTACGCTTATGATGCACTGGAACCGCACTTCGATAAGCAGACGATGGAGATTCACCA<br>CACCAAACACCATCAAACCTATGTCAACAACGCTAACGCGGCGCTGGAAAACCTGCCTGAGTTTGCTGACCTGCCGGCTGAAG<br>AACTGATTACTAAACTGGACCAGGTGCCAGCGGACAAAAAAACCGTGCTGCGTAACAACGCCGGCGGCCACGCTAACCACAG<br>CCTGTTCTGGAAAGGGCTGAAAAAAGGCACCACTCTGCAGGGCGACCTGAAAGCGGCTATCGAGCGTGACTTCGGTTCCGTT<br>GACAACTTCAAAGCTGAATTCGAAAAAGCAGCAGCAACCCGTTTCGGCTCCGGCTGGGCGTGGCTGGTGCTGAAAGGCGACA<br>AACTGGCTGTGGTTTCTACCGCAAACCAGGATTCCCCGCTGATGGGTGAAGCCATTTCCGGCGCTTCCGGCTTCCCGATCCT<br>GGGTCTGGACGTGTGGGAACACGCTTACTACCTGAATTCCAGAACCGCCGCCCGGACTACATCAAAGAGTTCTGGAACGTG<br>GTGAACTGGGACGAAGCAGCAGCGCGTTTCGCCGCTAAAAAATAA (SEQ ID NO: 565) |
| 106_HySe35_Schwarzengrund | |

Fig. 28A

| | |
|---|---|
| 01_NBRC13245T_Typhimurium | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 58) |
| 02_GTC00131_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 70) |
| 03_GTC09491_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 79) |
| 04_GTC03838_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 86) |
| 05_GTC08914_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 93) |
| 06_GTC09421_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 103) |
| 07_GTC09489_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 113) |
| 08_NBRC3163_Pullorum_Gallinarum | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 120) |
| 09_NBRC3313_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 130) |
| 10_NBRC12529_Typhimurium | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAATCGGCGTTCCTTTCGTTGATGGC GGCGTAATCAAAGCTGAAGTTGTTGCCCACGGTCGTGGCGAGAAAGTTAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 137) |

Fig. 28B

| | |
|---|---|
| 11_NBRC14193_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 144) |
| 12_NBRC14194_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 151) |
| 13_NBRC14209_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 158) |
| 14_NBRC14210_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 165) |
| 15_NBRC14211_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 171) |
| 16_NBRC14212_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 178) |
| 17_NBRC15181_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 185) |
| 18_NBRC15182_Minnesota | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGGTCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 195) |
| 19_NBRC15183_Minnesota | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 205) |
| 20_NBRC15184_Minnesota | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGGTCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 212) |
| 21_NBRC15185_Minnesota | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGGTCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 219) |
| 22_NBRC15186_Minnesota | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGGTCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 226) |
| 23_NBRC15187_Minnesota | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGGTCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 233) |
| 24_NBRC100797_Abony | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 240) |
| 25_NBRC105684_Choleraesuis | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 250) |
| 26_NBRC105726_Typhimurium | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 260) |
| 27_JCM3919_UN_O7_ | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 269) |
| 28_NBRC15335_Minnesota | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGGTCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 276) |
| 29_GTC09490_Enteritidis | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 283) |
| 30_GTC09492_Braenderup | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 290) |
| 31_GTC09493_Pakistan | ATGTACGCGGTTTTCCAAAGTGGTGGTAAACAACACCGAGTAAGCGAAGGTCAGACCGTTCGCCTGGAAAAGCTGGACATCGCA<br>ACTGGCGAAACTATCGAGTTCGCTGAAGTTCTGATGATCGCAAACGGTGAAGAAGTCAAAATCGGCGTTCCTTTCGTTGATGGC<br>GGCGTAATCAAAGCTGAAGTTGTTGCCCACGGTCGTGGGCGAGAAAGTTAAAATCGTTAAGTTTCGTCGCCGTAAACACTACCGT<br>AAGCAGCAGGGCCATCGTCAGTGGTTCACTGATGTGAAAATTACCGGCATCAGCGCTTAA (SEQ ID NO: 297) |

Fig. 28C

| | |
|---|---|
| 32_GTC09549_Typhimurium | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 304) |
| 33_ATCCBAA-1675_Infantis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 311) |
| 34_ATCCBAA-1738_Thompson | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 322) |
| 35_ATCC9712_Saintpaul | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 332) |
| 36_jfrlSe1402-1_Infantis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 343) |
| 38_jfrlSe1402-3_Brandenburg | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGGTCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 353) |
| 39_jfrlSe1402-4_Infantis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 360) |
| 40_jfrlSe1402-5_Brandenburg | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGGTCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 370) |
| 41_jfrlSe1402-6_Rissen | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 377) |
| 42_jfrlSe1402-7_Orion | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 384) |
| 43_jfrlSe1402-8_Rissen | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 394) |
| 44_jfrlSe1402-9_Rissen | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 401) |
| 45_jfrlSe1402-10_Rissen | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 408) |
| 46_jfrlSe1402-11_Rissen | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 415) |
| 47_jfrlSe1402-12_Rissen | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 422) |
| 48_jfrlSe1402-13_Mbandaka | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 429) |
| 49_jfrlSe1402-14_Mbandaka | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 439) |
| 50_jfrlSe1402-15_Orion | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 449) |
| 51_jfrlSe1409-1_Altona | |
| 52_jfrlSe1409-2_Istanbul | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 466) |
| 53_jfrlSe1409-3_Senftenberg | |
| 54_jfrlSe1409-4_UN_O13_ | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 478) |
| 55_jfrlSe1409-5_UN_O1,3,19_ | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGCGTTCCTTTCGTTGATGGC GGCGTAATCAAAGCTGAAGTTGTTGCCCACGGTCGTGGGGAGAAAGTTAAAATCGTTAAGTTTCGTCGCCGTAAACACTACCGT AAGCAGCAGGGCCATCGTCAGTGGTTCACTGATGTGAAAATTACCGGGCATCAGCGCTTAA (SEQ ID NO: 487) |

Fig. 28D

| | |
|---|---|
| 56_jfrISe1409-6_Montevideo | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGGTCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 495) |
| 57_jfrISe1409-7_UN_O1,3,19_ | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 503) |
| 58_jfrISe1409-8_UN_O18_ | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 512) |
| 61_jfrISe1409-11_UN_O1,3,19_ | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 521) |
| 67_jfrISe1409-17_Rissen | |
| 71_jfrISe1409-21_Amsterdam | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 538) |
| 80_HySe09_Enteritidis | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGATCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 548) |
| 100_HySe29_Schwarzengrund | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGGTCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 558) |
| 103_HySe32_Schwarzengrund | |
| 106_HySe35_Schwarzengrund | ATGTACGCGGTTTTCCAAAGTGGTGGTAAACAACACCGAGTAAGCGAAGGTCAGACCGTTCGCCTGGAAAAGCTGGACATCGCA ACTGGCGAAACTATCGAGTTCGCTGAAGTTCTGATGGTCGCAAACGGTGAAGAAGTCAAAATCGGGCGTTCCTTTCGTTGATGGC GGCGTAATCAAAGCTGAAGTTGTTGCCCACGGTCGTGGCGAGAAAGTTAAAATCGTTAAGTTTCGTCGCCGTAAACACTACCGT AAGCAGCAGGGCCATCGTCAGTGGTTCACTGATGTGAAAATTACCGGCATCAGCGCTTAA (SEQ ID NO: 572) |

Fig. 29A

| | |
|---|---|
| 01_NBRC13245T_Typhimurium | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 59) |
| 02_GTC00131_Enteritidis | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 71) |
| 03_GTC09491_Enteritidis | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 80) |
| 04_GTC03838_Enteritidis | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 87) |
| 05_GTC08914_Enteritidis | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 94) |
| 06_GTC09421_Enteritidis | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 104) |
| 07_GTC09489_Enteritidis | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 114) |
| 08_NBRC3163_Pullorum_Gallinarum | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 121) |
| 09_NBRC3313_Enteritidis | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 131) |
| 10_NBRC12529_Typhimurium | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 138) |
| 11_NBRC14193_Typhimurium | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 145) |
| 12_NBRC14194_Typhimurium | ATGTTTACTATCAACGCAGAAGTACGTAAAGAGCAGGGTAAGGGTGCGAGCCGCCGCCTGCGCGCCGCTAACAAGTTCCCGGC AATCATCTACGGCCGGTTCTGAAGCCCCGATTGCTATCGAACTGGACCACGACCAGGTGATGAACATGCAAGCTAAAGCTGAATT CTACAGCGAAGTTCTGACCCTCGTTGTTGACGGTAAAGAAGTAAAAGTTAAAGCTCAGGCTGTACAGCGTCACGCTTACAAACC GAAGCTGACTCACATCGACTTCGTTCGCGCGTAA (SEQ ID NO: 152) |

Fig. 29B

| | |
|---|---|
| 13_NBRC14209_Typhimurium | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 159) |
| 14_NBRC14210_Typhimurium | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 166) |
| 15_NBRC14211_Typhimurium | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 172) |
| 16_NBRC14212_Typhimurium | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 179) |
| 17_NBRC15181_Typhimurium | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 186) |
| 18_NBRC15182_Minnesota | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCATATCGACTTCGTTCGCGCGTAA (SEQ ID NO: 196) |
| 19_NBRC15183_Minnesota | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCATATCGACTTCGTTCGCGCGTAA (SEQ ID NO: 206) |
| 20_NBRC15184_Minnesota | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCATATCGACTTCGTTCGCGCGTAA (SEQ ID NO: 213) |
| 21_NBRC15185_Minnesota | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCATATCGACTTCGTTCGCGCGTAA (SEQ ID NO: 220) |
| 22_NBRC15186_Minnesota | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 227) |
| 23_NBRC15187_Minnesota | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCATATCGACTTCGTTCGCGCGTAA (SEQ ID NO: 234) |
| 24_NBRC100797_Abony | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 241) |
| 25_NBRC105684_Choleraesuis | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 251) |
| 26_NBRC105726_Typhimurium | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 261) |
| 27_JCM3919_UN_O7_ | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 270) |
| 28_NBRC15335_Minnesota | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCATATCGACTTCGTTCGCGCGTAA (SEQ ID NO: 277) |
| 29_GTC09490_Enteritidis | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 284) |
| 30_GTC09492_Braenderup | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCCGGTTGCTATCGAACTGGACCACGACCAGGTGATGAACATGCAAGCTAAAGCTGAATT<br>CTACAGCGAAGTTCTGACCCTCGTTGGTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 291) |
| 31_GTC09493_Pakistan | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 298) |
| 32_GTC09549_Typhimurium | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 305) |
| 33_ATCCBAA-1675_Infantis | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 312) |

Fig. 29C

| | |
|---|---|
| 34_ATCCBAA-1738_Thompson | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 323) |
| 35_ATCC9712_Saintpaul | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 333) |
| 36_jfrlSe1402-1_Infantis | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 344) |
| 38_jfrlSe1402-3_Brandenburg | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 354) |
| 39_jfrlSe1402-4_Infantis | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 361) |
| 40_jfrlSe1402-5_Brandenburg | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 371) |
| 41_jfrlSe1402-6_Rissen | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 378) |
| 42_jfrlSe1402-7_Orion | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 385) |
| 43_jfrlSe1402-8_Rissen | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 395) |
| 44_jfrlSe1402-9_Rissen | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 402) |
| 45_jfrlSe1402-10_Rissen | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 409) |
| 46_jfrlSe1402-11_Rissen | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 416) |
| 47_jfrlSe1402-12_Rissen | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 423) |
| 48_jfrlSe1402-13_Mbandaka | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 430) |
| 49_jfrlSe1402-14_Mbandaka | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 440) |
| 50_jfrlSe1402-15_Orion | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGATTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 450) |
| 51_jfrlSe1409-1_Altona | |
| 52_jfrlSe1409-2_Istanbul | |
| 53_jfrlSe1409-3_Senftenberg | |
| 54_jfrlSe1409-4_UN_O13_ | |
| 55_jfrlSe1409-5_UN_O1,3,19_ | |
| 56_jfrlSe1409-6_Montevideo | |
| 57_jfrlSe1409-7_UN_O1,3,19_ | |
| 58_jfrlSe1409-8_UN_O18_ | |
| 61_jfrlSe1409-11_UN_O1,3,19_ | |
| 67_jfrlSe1409-17_Rissen | |
| 71_jfrlSe1409-21_Amsterdam | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGGTTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 539) |
| 80_HySe09_Enteritidis | ATGTTTACTATCAACGCAGAAGTACGTAAAGAGCAGGGTAAGGGTGCGAGCCGCCGCCTGCGCGCCGCTAACAAGTTCCCGGC<br>AATCATCTACGGCGGTTCTGAAGCCCCGGTTGCTATCGAACTGGACCACGACCAGGTGATGAACATGCAAGCTAAAGCTGAATT<br>CTACAGCGAAGTTCTGACCCTCGTTGTTGACGGTAAAGAAGTAAAAGTTAAAGCTCAGGCTGTACAGCGTCACGCTTACAAACC<br>GAAGCTGACTCACATCGACTTCGTTCGCGCGTAA (SEQ ID NO: 549) |
| 100_HySe29_Schwarzengrund | |
| 103_HySe32_Schwarzengrund | |
| 106_HySe35_Schwarzengrund | |

Fig. 30A

| | S7 |
|---|---|
| 01_NBRC13245T_Typhimurium | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCCTGGCGAACGAACTTTCTGATGCTGCAGACAACAAAGGTACTGCAGTTAAGAAACGTGAAGA CGTTCACCGTATGGCAGAAGCCAACAAGGCGTTCGCACACTACCGTTGGTAA (SEQ ID NO: 59) |
| 02_GTC00131_Enteritidis | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 72) |
| 03_GTC09491_Enteritidis | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 81) |
| 04_GTC03838_Enteritidis | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 88) |
| 05_GTC08914_Enteritidis | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 95) |
| 06_GTC09421_Enteritidis | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 105) |
| 07_GTC09489_Enteritidis | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 115) |
| 08_NBRC3163_Pullorum_Gallinarum | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAGCGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 122) |
| 09_NBRC3313_Enteritidis | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCTCTGGCGAACGAACTTTCTGACGCTGCAGAAAACAAAGGTACTGCAGTTAAGAAACGTGAAGA CGTTCACCGTATGGCAGAAGCCAACAAGGCGTTCGCACACTACCGTTGGTAA (SEQ ID NO: 132) |
| 10_NBRC12529_Typhimurium | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCCTGGCGAACGAACTTTCTGATGCTGCAGACAACAAAGGTACTGCAGTTAAGAAACGTGAAGA CGTTCACCGTATGGCAGAAGCCAACAAGGCGTTCGCACACTACCGTTGGTAA (SEQ ID NO: 139) |
| 11_NBRC14193_Typhimurium | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCCTGGCGAACGAACTTTCTGATGCTGCAGACAACAAAGGTACTGCAGTTAAGAAACGTGAAGA CGTTCACCGTATGGCAGAAGCCAACAAGGCGTTCGCACACTACCGTTGGTAA (SEQ ID NO: 146) |
| 12_NBRC14194_Typhimurium | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCCTGGCGAACGAACTTTCTGATGCTGCAGACAACAAAGGTACTGCAGTTAAGAAACGTGAAGA CGTTCACCGTATGGCAGAAGCCAACAAGGCGTTCGCACACTACCGTTGGTAA (SEQ ID NO: 153) |
| 13_NBRC14209_Typhimurium | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCCTGGCGAACGAACTTTCTGATGCTGCAGACAACAAAGGTACTGCAGTTAAGAAACGTGAAGA CGTTCACCGTATGGCAGAAGCCAACAAGGCGTTCGCACACTACCGTTGGTAA (SEQ ID NO: 160) |
| 14_NBRC14210_Typhimurium | ATGCCACGTCGTCGCGTCATTGGTCAGCGTAAAATTCTGCCGGATCCGAAGTTCGGATCAGAACTGCTGGCTAAATTTGTCAAT ATCCTGATGGTAGATGGTAAAAAATCTACTGCAGAATCAATCGTATACAGCGCGCTGGAGACCCTGGCTCAGCGTTCTGGTAAA TCTGAACTGGAAGCTTTCGAAGTCGCTCTCGAAAACGTTCGCCCGACTGTAGAAGTTAAATCCCGCCGTGTAGGTGGTTCTACT TATCAGGTACCAGTTGAAGTCCGTCCGGTCCGTCGTAATGCTCTGGCAATGCGTTGGATCGTAGAAGCTGCTCGTAAACGCGG TGATAAATCCATGGCTCTGCGCCTGGCGAACGAACTTTCTGATGCTGCAGACAACAAAGGTACTGCAGTTAAGAAACGTGAAGA CGTTCACCGTATGGCAGAAGCCAACAAGGCGTTCGCACACTACCGTTGGTAA (SEQ ID NO: 167) |

Fig. 30B

| | |
|---|---|
| 15_NBRC14211_Typhimurium | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 173) |
| 16_NBRC14212_Typhimurium | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 180) |
| 17_NBRC15181_Typhimurium | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 187) |
| 18_NBRC15182_Minnesota | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 197) |
| 19_NBRC15183_Minnesota | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 207) |
| 20_NBRC15184_Minnesota | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 214) |
| 21_NBRC15185_Minnesota | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 221) |
| 22_NBRC15186_Minnesota | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 228) |
| 23_NBRC15187_Minnesota | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 235) |
| 24_NBRC100797_Abony | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 242) |
| 25_NBRC105684_Choleraesuis | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGCATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 252) |
| 26_NBRC105726_Typhimurium | |
| 27_JCM3919_UN_O7_ | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 271) |
| 28_NBRC15335_Minnesota | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 278) |
| 29_GTC09490_Enteritidis | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCTCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 285) |

Fig. 30C

| | |
|---|---|
| 30_GTC09492_Braenderup | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 292) |
| 31_GTC09493_Pakistan | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 299) |
| 32_GTC09549_Typhimurium | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 306) |
| 33_ATCCBAA-1675_Infantis | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 313) |
| 34_ATCCBAA-1738_Thompson | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 324) |
| 35_ATCC9712_Saintpaul | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 334) |
| 36_jfrlSe1402-1_Infantis | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 345) |
| 38_jfrlSe1402-3_Brandenburg | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 355) |
| 39_jfrlSe1402-4_Infantis | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 362) |
| 40_jfrlSe1402-5_Brandenburg | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 372) |
| 41_jfrlSe1402-6_Rissen | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 379) |
| 42_jfrlSe1402-7_Orion | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 386) |
| 43_jfrlSe1402-8_Rissen | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 396) |
| 44_jfrlSe1402-9_Rissen | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 403) |

Fig. 30D

| | |
|---|---|
| 45_jfrlSe1402-10_Rissen | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 410) |
| 46_jfrlSe1402-11_Rissen | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 417) |
| 47_jfrlSe1402-12_Rissen | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGATGCTGCAGAACAAAGGTACTGCAGTTAAGAAACGTGAAGA<br>CGTTCACCGTATGGCAGAAGCCAACAAGGCGTTCGCACACTACCGTTGGTAA (SEQ ID NO: 424) |
| 48_jfrlSe1402-13_Mbandaka | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 431) |
| 49_jfrlSe1402-14_Mbandaka | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 441) |
| 50_jfrlSe1402-15_Orion | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGACAACAAAGGTACTGCAGTTAAGAAACGTGAAGA<br>CGTTCACCGTATGGCAGAAGCCAACAAGGCGTTCGCACACTACCGTTGGTAA (SEQ ID NO: 451) |
| 51_jfrlSe1409-1_Altona | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 458) |
| 52_jfrlSe1409-2_Istanbul | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 467) |
| 53_jfrlSe1409-3_Senftenberg | |
| 54_jfrlSe1409-4_UN_O13_ | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 479) |
| 55_jfrlSe1409-5_UN_O1,3,19_ | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 488) |
| 56_jfrlSe1409-6_Montevideo | |
| 57_jfrlSe1409-7_UN_O1,3,19_ | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 504) |
| 58_jfrlSe1409-8_UN_O18_ | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 513) |
| 61_jfrlSe1409-11_UN_O1,3,19_ | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 522) |
| 67_jfrlSe1409-17_Rissen | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 530) |

Fig. 30E

| | |
|---|---|
| 71_jfrlSe1409-21_Amsterdam | ATGGCAACAGTTAACCAGCTGGTACGCAAACCACGTGCTCGCAAAGTTGCGAAAAGCAACGTGCCTGCGCTGGAAGCATGCCC<br>GCAAAAACGTGGCGTATGTACTCGTGTATATACTACCACTCCTAAAAAACCGAACTCCGCACTGCGTAAAGTTTGCCGTGTTCG<br>TCTGACTAACGGTTTTGAAGTGACTTCCTACATCGGTGGTGAAGGTCACAACCTGCAGGAGCACTCCGTGATCCTGATCCGTG<br>GCGGTCGTGTTAAAGACCTCCCGGGTGTTCGTTACCACACCGTTCGTGGCGCGCTTGACTGCTCCGGCGTTAAAGACCGTAAG<br>CAAGCTCGTTCTAAGTACGGCGTGAAGCGTCCTAAGGCTTAA (SEQ ID NO: 540) |
| 80_HySe09_Enteritidis | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 550) |
| 100_HySe29_Schwarzengrund | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 559) |
| 103_HySe32_Schwarzengrund | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 566) |
| 106_HySe35_Schwarzengrund | ATGCCACGTCGTCGCGTCATTGGTCAGCGTAAAATTCTGCCGGATCCGAAGTTCGGATCAGAACTGCTGGCTAAATTTGTCAAT<br>ATCCTGATGGTAGATGGTAAAAAATCTACTGCAGAATCAATCGTATACAGCGCGCTGGAGACCCTGGCTCAGCGTTCTGGTAAA<br>TCTGAACTGGAAGCTTTCGAAGTCGCTCTCGAAAACGTTCGCCCGACTGTAGAAGTTAAATCCCGCCGTGTAGGTGGTTCTACT<br>TATCAGGTACCAGTTGAAGTCCGTCCGGTCCGTCGTAATGCTCTGGCAATGCGTTGGATCGTAGAAGCTGCTCGTAAACGCGG<br>TGATAAATCCATGGCTCTGCGCCTGGCGAACGAACTTTCTGACGCTGCAGAAAACAAAGGTACTGCAGTTAAGAAACGTGAAGA<br>CGTTCACCGTATGGCAGAAGCCAACAAGGCGTTCGCACACTACCGTTGGTAA (SEQ ID NO: 573) |

Fig. 31A

| | gns |
|---|---|
| 01_NBRC13245T_Typhimurium | ATGAACAGCGAAGAGTTGACACATAAAGCAGAAGAGGAAATCGCGGCACTCATTAGCAAAAAGGTTGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 59) |
| 02_GTC00131_Enteritidis | |
| 03_GTC09491_Enteritidis | |
| 04_GTC03838_Enteritidis | |
| 05_GTC08914_Enteritidis | ATGAACAGCGAAGAGTTGACACATAAAGCAGAAGAGGAAATCGCGGCACTCATTAGCAAAAAGGTCGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 96) |
| 06_GTC09421_Enteritidis | ATGAACAGCGAAGAGTTGACACATAAAGCAGAAGAGGAAATCGCGGCACTCATTAGCAAAAAGGTCGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 106) |
| 07_GTC09489_Enteritidis | |
| 08_NBRC3163_Pullorum_Gallinarum | ATGAACAGCGAAGAGTTGACACATAAAGCAGAAGAGGAAATCGCGGCACTCATTAGCAAAAAGGTCGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 123) |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | ATGAACAGCGAAGAGTTGACACATAAAGCAGAAGAGGAAATCGCGGCACTCATTAGCAAAAAGGTCGCCGAACTACGGAAGAAA<br>ACCGGGCAAGAGGTTTCCGAAATAGAGTTCGTGCCGCGAGAAACGATGAAAGGGCTTGAGGGATACCACGTTAAAATTAAACTA<br>CTCTAG (SEQ ID NO: 188) |
| 18_NBRC15182_Minnesota | ATGAACAGCGAAGAGTTGACACATAAAGCAGAAGAGGAAATCGCGGCACTCATTAGCAAAAAGGTTGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 198) |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | ATGAACAGCGAAGAGTTGACACATAAAGCAGAAGAGGAAATCGCGGCACTCATTAGCAAAAAGGTTGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 243) |
| 25_NBRC105684_Choleraesuis | ATGAACAGCGAAGAGTTGACACATAAAGCAGAAGAGGAAATCGCGGCACTCATTAGCAAAAAGGTTGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 253) |
| 26_NBRC105726_Typhimurium | ATGAACAGCGAAGAGTTGACACATAAAGCAGAAGAGGAAATCGCGGCACTCATTAGCAAAAAGGTTGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 262) |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | ATGAACAGCGAAGAGTTGACACATAAAGCAGAAGAGGAAATCGCGGCACTCATTAGCAAAAAGGTTGCCGAACTACGGAAGAAA<br>ACCGGGCAAGAGGTTTCCGAAATAGAGTTCGCGCCGCGAGAAACGATGAAAGGGCTTGAGGGATACCACGTTAAAATTAAACTA<br>CTCTAG (SEQ ID NO: 314) |

Fig. 31B

| | |
|---|---|
| 34_ATCCBAA-1738_Thompson | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 325) |
| 35_ATCC9712_Saintpaul | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 335) |
| 36_jfrlSe1402-1_Infantis | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 346) |
| 38_jfrlSe1402-3_Brandenburg | |
| 39_jfrlSe1402-4_Infantis | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 363) |
| 40_jfrlSe1402-5_Brandenburg | |
| 41_jfrlSe1402-6_Rissen | |
| 42_jfrlSe1402-7_Orion | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 387) |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | ATGAACAGCGAAGAGTTGACACATAAAGCAGAAGAGGAAATCGCGGCACTCATTAGCAAAAAGGTCGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 432) |
| 49_jfrlSe1402-14_Mbandaka | ATGAACAGCGAAGAGTTGACACATAAAGCAGAAGAGGAAATCGCGGCACTCATTAGCAAAAAGGTCGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 442) |
| 50_jfrlSe1402-15_Orion | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 452) |
| 51_jfrlSe1409-1_Altona | ATGAACAGCGAAGAGTTGACACATAAAGCAGAAGAGGAAATCGCGGCACTCATTAGCAAAAAGGTCGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 459) |
| 52_jfrlSe1409-2_Istanbul | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 468) |
| 53_jfrlSe1409-3_Senftenberg | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 471) |
| 54_jfrlSe1409-4_UN_O13_ | ATGAACAGCGAAGAGTTGACACATAAAGCAGAAGAGGAAATCGCGGCACTCATTAGCAAAAAGGTCGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 480) |
| 55_jfrlSe1409-5_UN_O1,3,19_ | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 489) |
| 56_jfrlSe1409-6_Montevideo | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 496) |
| 57_jfrlSe1409-7_UN_O1,3,19_ | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 505) |
| 58_jfrlSe1409-8_UN_O18_ | ATGAACAGCGAAGAGTTGACACATAAAGCAGAAGAGGAAATCGCGGCACTCATAAGCAAAAAGGTCGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 514) |
| 61_jfrlSe1409-11_UN_O1,3,19_ | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 523) |
| 67_jfrlSe1409-17_Rissen | ATGAACAGCGAAGAGTTGACACATAAAGCAGAAGAGGAAATCGCGGCACTCATTAGCAAAAAGGTTGCCGAACTACGGAAGAAA ACTGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 531) |
| 71_jfrlSe1409-21_Amsterdam | ATGAACAGCGAAGAGTTGACACATAAAGCAGAAGAGGAAATCGCGGCACTCATTAGCAAAAAGTCGCCGAACTACGGAAGAAA ACCGGGCAAGAGGTTTCCGAAATAGAGTTCGTGCCGCGAGAAACGATGAAAGGGCTTGAGGGCTACCACGTTAAAATTAAACTA CTCTAG (SEQ ID NO: 541) |
| 80_HySe09_Enteritidis | ATGAACAGCGAAGAGTTGACACATAAAGCAGAAGAGGAAATCGCGGCACTCATTAGCAAAAAGGTCGCCGAACTACGGAAGAAA ACCGGGCAAGAGGTTTCCGAAATAGAGTTCGTGCCGCGAGAAACGATGAAAGGGCTTGAGGGCTACCACGTTAAAATTAAACTA CTCTAG (SEQ ID NO: 551) |
| 100_HySe29_Schwarzengrund | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGCGCCGCGAGAAACGATGAAAGGGCTTGAGGGATACCACGTTAAAATTAAACTA CTCTAG (SEQ ID NO: 560) |
| 103_HySe32_Schwarzengrund | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 567) |
| 106_HySe35_Schwarzengrund | ATGAACAGCGAAGAGTTGACACATAAAGCAGAAGAGGAAATCGCGGCACTCATTAGCAAAAAGGTTGCCGAACTACGGAAGAAA ACCGGGCAAGAGGTTTCCGAAATAGAGTTCGTGCCGCGAGAAACGATGAAAGGGCTTGAGGGATACCACGTTAAAATTAAACTA CTCTAG (SEQ ID NO: 574) |

Fig. 32A

| | yibT |
|---|---|
| 01_NBRC13245T_Typhimurium | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 62) |
| 02_GTC00131_Enteritidis | |
| 03_GTC09491_Enteritidis | |
| 04_GTC03838_Enteritidis | |
| 05_GTC08914_Enteritidis | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 97) |
| 06_GTC09421_Enteritidis | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 107) |
| 07_GTC09489_Enteritidis | |
| 08_NBRC3163_Pullorum_Gallinarum | ATGGCAAAAATAGGTGAGAACGTACCACTTCTTATTGATAAAGCCGTCGATTTTAAGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 124) |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 189) |
| 18_NBRC15182_Minnesota | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 199) |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | ATGGCAAAAATAGGTGAGAACGTACCACTTCTTATTGATAAAGCCGTCGATTTTATGGCGTCCAGCCAGGCGTTCCGTGAGTACTTGAATAAAACGCCGCCGCGTGATTATGTTCCTTCCGAAGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 244) |
| 25_NBRC105684_Choleraesuis | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 254) |
| 26_NBRC105726_Typhimurium | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 263) |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 315) |
| 34_ATCCBAA-1738_Thompson | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGGAGTTAA (SEQ ID NO: 326) |
| 35_ATCC9712_Saintpaul | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGCATATTACCGACGGTTGTACCGACCAAAAGAAGAAGAAAGAGGTTAA (SEQ ID NO: 336) |
| 36_jfrlSe1402-1_Infantis | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 347) |
| 38_jfrlSe1402-3_Brandenburg | |
| 39_jfrlSe1402-4_Infantis | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 364) |
| 40_jfrlSe1402-5_Brandenburg | |
| 41_jfrlSe1402-6_Rissen | |
| 42_jfrlSe1402-7_Orion | ATGGCAAAAATAGGTGAGAACGTACCACTTCTTATTGATAAAGCCGTCGATTTTATGGCGTCCAGCCAGGCGTTCCGTGAATACTTGAATAAAACGCCGCCGCGTGATTATGTTCCTTCCGAAGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 388) |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | |
| 49_jfrlSe1402-14_Mbandaka | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGAATATTACCGACGGCTGTACCGACCAAAAGAAGAAGAAAGAGGTTAA (SEQ ID NO: 443) |
| 50_jfrlSe1402-15_Orion | ATGGCAAAAATAGGTGAGAACGTACCACTTCTTATTGATAAAGCCGTCGATTTTATGGCGTCCAGCCAGGCGTTCCGTGAATACTTGAATAAAACGCCGCCGCGTGATTATGTTCCTTCCGAAGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 453) |
| 51_jfrlSe1409-1_Altona | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGAATATTACCGACGGCTGTACCGACCAAAAGAAGAAGAAAGAGGTTAACGGCGGGATTT (SEQ ID NO: 460) |

Fig. 32B

| | |
|---|---|
| 52_jfrlSe1409-2_Istanbul | ATGGCAAAAATAGGTGAGAACGTACCACTTCTTATTGATAAAGCCGTCGATTTTATGGCGTCCAGCCAGGCGTTCCGTGAGTACTTGAATAAAACGCCGCCGCGTGACTATGTTCCTTCCGAAGTGCCGTCGGAGAGCGCGCCCATTTATTTGCAGCGTCTGGAATATTACCGGCGGCTGTACCGACCAAAAGAAGAAAGAGGTTAACGGCGG (SEQ ID NO: 469) |
| 53_jfrlSe1409-3_Senftenberg | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGCATATTACCGACGGTTGTACCGACCAAAAGAAGAAGAAAGAGGTTAA (SEQ ID NO: 472) |
| 54_jfrlSe1409-4_UN_O13_ | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGAATATTACCGACGGCTGTACCGACCAAAAGAAGAAGAAAGAGGTTAA (SEQ ID NO: 481) |
| 55_jfrlSe1409-5_UN_O1,3,19_ | ATGGCAAAAATAGGTGAGAACGTACCACTTCTTATTGATAAAGCCGTCGATTTTATGGCGTCCAGCCAGGCGTTCCGTGAATTCAAGTATAAAACGCCGCCGCGTGATTATGTTCCTTCCGAAGTGCCGTCGGAGAGCGCGCCCATTTATTTGCAGCGTCTGGCATATTACCGACGGTTGTACCGACCAAAAGAAGAAGAAAGAGGTTAA (SEQ ID NO: 490) |
| 56_jfrlSe1409-6_Montevideo | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 497) |
| 57_jfrlSe1409-7_UN_O1,3,19_ | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGCATATTACCGACGGTTGTACCGACCAAAAGAAGAAGAAAGAGGTTAA (SEQ ID NO: 506) |
| 58_jfrlSe1409-8_UN_O18_ | ATGGCAAAAATAGGTGAGAACGTACCACTTCTTATTGATAAAGCCGTCGATTTTATGGCGTCCAGCCAGGCGTTCCGTGAGTACTTGAATAAAACGCCGCCGCGTGATTATGTTCCTTCCGAAGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 515) |
| 61_jfrlSe1409-11_UN_O1,3,19_ | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGCATATTACCGACGGTTGTACCGACCAAAAGAAGAAGAAAGAGGTTAA (SEQ ID NO: 524) |
| 67_jfrlSe1409-17_Rissen | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAAGTGCCGTCGGAGAGCGCGCCCATTTATTTGCAGCGTCTGGAATATTACCGACGGCTGTACCGACCAAAAGAAGAAGAAAGAGGTTAA (SEQ ID NO: 532) |
| 71_jfrlSe1409-21_Amsterdam | ATGGCAAAAATAGGTGAGAACGTACCACTTCTTATTGATAAAGCCGTCGATTTTATGGCGTCCAGCCAGGCGTTCCGTGAATACTTGAATAAAACGCCGCCGCGTGATTATGTTCCTTCCGAAGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 542) |
| 80_HySe09_Enteritidis | ATGGCAAAAATAGGTGAGAACGTACCACTTCTTATTGATAAAGCCGTCGATTTTATGGCGTCCAGCCAGGCGTTCCGTGAATACCTGAATAAAACGCCGCCGCGTGATTATGTTCCTTCCGAGGTGCCGTCGGAGAGCGCGCCCATTTATTTGCAGCGTCTGGAATATTACCGGCGGCTGTACCGACCAAAAGAAGAAGAAAGAGGTTAA (SEQ ID NO: 552) |
| 100_HySe29_Schwarzengrund | |
| 103_HySe32_Schwarzengrund | |
| 106_HySe35_Schwarzengrund | |

Fig. 33A

| | ppiC |
|---|---|
| 01_NBRC13245T_Typhimurium | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGTAAATAA (SEQ ID NO: 63) |
| 02_GTC00131_Enteritidis | |
| 03_GTC09491_Enteritidis | |
| 04_GTC03838_Enteritidis | |
| 05_GTC08914_Enteritidis | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGCAAATAA (SEQ ID NO: 98) |
| 06_GTC09421_Enteritidis | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGCAAATAA (SEQ ID NO: 108) |
| 07_GTC09489_Enteritidis | |
| 08_NBRC3163_Pullorum_Gallinarum | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGCAAATAA (SEQ ID NO: 125) |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGTAAATAA (SEQ ID NO: 190) |
| 18_NBRC15182_Minnesota | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGTAAATAA (SEQ ID NO: 200) |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | ATGGCAAAAATGGCAGCAGCACTGCATATCCTTGTAAAAGAAGAGAAACTGGCATTGGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCATTGCACACCCAGTTCGGT<br>TATCACATCATTAAGGTATTGTATCGCAAATAA (SEQ ID NO: 245) |
| 25_NBRC105684_Choleraesuis | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCATTGCACACCCAGTTCGGT<br>TATCACATCATTAAGGTATTGTATCGCAAATAA (SEQ ID NO: 255) |
| 26_NBRC105726_Typhimurium | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGCAAATAA (SEQ ID NO: 264) |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGCAAATAA (SEQ ID NO: 316) |
| 34_ATCCBAA-1738_Thompson | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGTAAATAA (SEQ ID NO: 327) |
| 35_ATCC9712_Saintpaul | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGTAAATAA (SEQ ID NO: 337) |
| 36_jfrlSe1402-1_Infantis | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAGGTATTGTATCGCAAATAA (SEQ ID NO: 348) |
| 38_jfrlSe1402-3_Brandenburg | |
| 39_jfrlSe1402-4_Infantis | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAGGTATTGTATCGCAAATAA (SEQ ID NO: 365) |
| 40_jfrlSe1402-5_Brandenburg | |
| 41_jfrlSe1402-6_Rissen | |
| 42_jfrlSe1402-7_Orion | ATGGCAAAAATGGCAGCAGCACTGCATATCCTTGTAAAAGAAGAGAAACTGGCATTGGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCATTGCACACCCAGTTCGGT<br>TATCACATCATTAAGGTATTGTATCGCAAATAA (SEQ ID NO: 389) |

Fig. 33B

| | |
|---|---|
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAAGTATTGTATCGCAAATAA (SEQ ID NO: 433) |
| 49_jfrlSe1402-14_Mbandaka | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAAGTATTGTATCGCAAATAA (SEQ ID NO: 444) |
| 50_jfrlSe1402-15_Orion | ATGGCAAAAATGGCAGCAGCACTGCATATCCTTGTAAAAGAAGAGAAACTGGCATTGGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCATTGCACACCCAGTTCGGT<br>TATCACATCATTAAGGTATTGTATCGCAAATAA (SEQ ID NO: 454) |
| 51_jfrlSe1409-1_Altona | ATGGCAAAAATGGCAGCAGCACTGCATATCCTTGTAAAAGAAGAGAAACTGGCATTGGATCTTCTGGAGCAAATTAAAAACGGC<br>GGCGATTTTGAGAAGCTGGCGAAGAAACATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCATTGCACACCCAGTTCGGT<br>TATCACATCATTAAGGTATTGTATCGCAAATAA (SEQ ID NO: 461) |
| 52_jfrlSe1409-2_Istanbul | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAAGTATTGTATCGCAAATAA (SEQ ID NO: 470) |
| 53_jfrlSe1409-3_Senftenberg | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAAGTATTGTATCGCAAATAA (SEQ ID NO: 473) |
| 54_jfrlSe1409-4_UN_O13_ | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAAGTATTGTATCGCAAATAA (SEQ ID NO: 482) |
| 55_jfrlSe1409-5_UN_O1,3,19_ | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAAGTATTGTATCGCAAATAA (SEQ ID NO: 491) |
| 56_jfrlSe1409-6_Montevideo | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAAGTATTGTATCGCAAATAA (SEQ ID NO: 498) |
| 57_jfrlSe1409-7_UN_O1,3,19_ | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAAGTATTGTATCGCAAATAA (SEQ ID NO: 507) |
| 58_jfrlSe1409-8_UN_O18_ | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAAGTATTGTATCGCAAATAA (SEQ ID NO: 516) |
| 61_jfrlSe1409-11_UN_O1,3,19_ | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAAGTATTGTATCGCAAATAA (SEQ ID NO: 525) |
| 67_jfrlSe1409-17_Rissen | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACTCAGTTCGGT<br>TACCACATCATTAAAGTATTGTATCGCAAATAA (SEQ ID NO: 533) |
| 71_jfrlSe1409-21_Amsterdam | ATGGCAAAAATGGCAGCAGCACTGCATATCCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAGGTATTGTATCGTAAATAA (SEQ ID NO: 543) |
| 80_HySe09_Enteritidis | ATGGCAAAAATGGCAGCAGCACTGCATATTCTTGTAAAAGAAGAGAAACTAGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAAGTATTGTATCGCAAATAA (SEQ ID NO: 553) |
| 100_HySe29_Schwarzengrund | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTATTTTCCTGCCCGGTACTGGAGCCAACCGGCCCGCTGCATACCCAGTTCGGT<br>TACCACATCATTAAAGTATTGTATCGCAAATAA (SEQ ID NO: 561) |
| 103_HySe32_Schwarzengrund | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTATTTTCCTGCCCGGTACTGGAGCCAACCGGCCCGCTGCATACCCAGTTCGGT<br>TACCACATCATTAAAGTATTGTATCGCAAATAA (SEQ ID NO: 568) |
| 106_HySe35_Schwarzengrund | ATGGCAAAAATGGCAGCAGCACTGCATATTCTTGTAAAAGAAGAGAAACTGGCTTTAGATCTTCTGGAGCAAATTAAAAACGGC<br>GGCGATTTTGAGAAGCTGGCGAAGAAGCATTCTATCTGCCCATCCGGTAAAAAAGGCGGTCATTTAGGCGAATTTCGTCAGGG<br>CCAGATGGTTCCGGCATTCGATAAAGTAGTCTTTTCCTGCCCGGTACTGGAGCCAACCGGCCCGCTGCATACCCAGTTCGGT<br>TACCACATCATTAAAGTATTGTATCGCAAATAA (SEQ ID NO: 575) |

Fig. 34

| | yaiA |
|---|---|
| 01_NBRC13245T_Typhimurium | ATGCCAACCAGACCACCTTATCCGCGGGAAGCTTATATCGTCACCATTGAAAAAGGCACGCCGGGCCAGACGGTGACGTGGTATCAGCTACGGGCTGACCATCCGAAACCTGATTCGCTCATCAGCGAGCATCCGACCGCAGAAGAAGCGATGGATGCGAAAAATCGTTACGAAGATCCGGATAAATCATAG (SEQ ID NO: 64) |
| 02_GTC00131_Enteritidis | ATGCCAACCAGACCACCTTATCCGCGGGAAGCTTATATCGTCACCATTGAAAAAGGCACGCCGGGCCAGACGGTGACGTGGTATCAGCTACGGGCTGACCATCCGAAACCTGATTCGCTCATCAGCGAGCATCCGACCGCAGAAGAAGCGATGGATGCGAAAAAACGTTACGAAGATCCGGATAAATCATAG (SEQ ID NO: 73) |
| 03_GTC09491_Enteritidis | |
| 04_GTC03838_Enteritidis | |
| 05_GTC08914_Enteritidis | |
| 06_GTC09421_Enteritidis | |
| 07_GTC09489_Enteritidis | |
| 08_NBRC3163_Pullorum_Gallinarum | |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | |
| 18_NBRC15182_Minnesota | |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | |
| 25_NBRC105684_Choleraesuis | |
| 26_NBRC105726_Typhimurium | |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | |
| 34_ATCCBAA-1738_Thompson | |
| 35_ATCC9712_Saintpaul | ATGCCAACCAGACCACCTTATCCGCGGGAAGCTTATATCGTCACCATTGAAAAAGGCACGCCGGGCCAGACGGTGACGTGGTATCAGCTACGGGCTGACCATCCGAAACCTGATTCGCTCATCAGCGAGCATCCGACCGCAGAAGAAGCGATGGATGCGAAAAAACGTTACGAAGATCCGGATAAATCATAG (SEQ ID NO: 338) |
| 36_jfrlSe1402-1_Infantis | |
| 38_jfrlSe1402-3_Brandenburg | |
| 39_jfrlSe1402-4_Infantis | |
| 40_jfrlSe1402-5_Brandenburg | |
| 41_jfrlSe1402-6_Rissen | |
| 42_jfrlSe1402-7_Orion | |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | |
| 49_jfrlSe1402-14_Mbandaka | |
| 50_jfrlSe1402-15_Orion | |
| 51_jfrlSe1409-1_Altona | |
| 52_jfrlSe1409-2_Istanbul | |
| 53_jfrlSe1409-3_Senftenberg | |
| 54_jfrlSe1409-4_UN_O13_ | |
| 55_jfrlSe1409-5_UN_O1,3,19_ | |
| 56_jfrlSe1409-6_Montevideo | |
| 57_jfrlSe1409-7_UN_O1,3,19_ | |
| 58_jfrlSe1409-8_UN_O18_ | |
| 61_jfrlSe1409-11_UN_O1,3,19_ | |
| 67_jfrlSe1409-17_Rissen | |
| 71_jfrlSe1409-21_Amsterdam | |
| 80_HySe09_Enteritidis | |
| 100_HySe29_Schwarzengrund | |
| 103_HySe32_Schwarzengrund | |
| 106_HySe35_Schwarzengrund | |

Fig. 35A

| | yciF |
|---|---|
| 01_NBRC13245T_Typhimurium | ATGAATATCAAAACCGTTGAAGACCTTTTTATCCATCTACTTTCAGATACCTATAGTGCAGAAAAACAATTAACCAAGGCTCTTCCTAAACTTGCCAGAGCCACGTCCAATGAAAAATTAAGCCAGGCCTTTCAATCTCATCTTGAAGAAACCCAGGGTCAGATTGAACGTATTGATCAGATCGTCGAATCTGAATCTGGCATTAAACTGAAAAGAATGAAATGCGTCGCTATGGAAGGGCTGATTGAAGAAGCCAATGAAGTCATCGAAAGTACGGAGAAAAACGAAGTACGCGATGCAGCGCTTATCGCCGCGGCGCAAAAAGTCGAGCATTACGAAATCGCCAGCTACGGCACGCTAGCCACCCTGGCCGAGCAGCTCGGCTATAGCAAAGCATTAAAACTGCTCAAAGAAACCCTCGACGAGGAAAAACAAACTGATTTAAAACTTACCGATTTAGCAGTCAGCAATGTTAATAAAAGTGCTGAACGCAAATCGAAATAA (SEQ ID NO: 65) |
| 02_GTC00131_Enteritidis | ATGAATATCAAAACCGTTGAAGACCTTTTTATCCATCTACTTTCAGATACCTATAGTGCAGAAAAACAATTAACCAAGGCTCTTTCTAAACTAGCCAGAGCCACGTCCAATGAAAAATTAAGCCAGGCCTTTCAATCTCATCTTGAAGAAACCCAGGGTCAGATTGAACGTATTGATCAGATCGTCGAATCTGAATCTGGCATTAAACTGAAAAGAATGAAATGCGTCGCTATGGAAGGGCTGATCGAAGAAGCCAATGAAGTCATCGAAAGTACGGAGAAAAACGAAGTACGCGATGCAGCGCTTATCGCCGCGGCGCAAAAAGTCGAGCATTACGAAATCGCCAGCTACGGCACGCTAGCCACCCTGGCCGAGCAGCTCGGCTATAGCAAGGCATTAAAACTGCTCAAAGAAACCCTCGACGAGGAAAAACAAACTGATTTAAAACTTACCGATTTAGCAGTCAGCAATGTTAATAAAAGTGCTGAACGCAAATCGAAATAA (SEQ ID NO: 74) |
| 03_GTC09491_Enteritidis | |
| 04_GTC03838_Enteritidis | |
| 05_GTC08914_Enteritidis | |
| 06_GTC09421_Enteritidis | |
| 07_GTC09489_Enteritidis | |
| 08_NBRC3163_Pullorum_Gallinarum | |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | |
| 18_NBRC15182_Minnesota | |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | |
| 25_NBRC105684_Choleraesuis | |
| 26_NBRC105726_Typhimurium | |
| 27_JCM3919_UN_O7 | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | ATGAATATTAAAACCGTTGAAGACCTTTTTATCCATCTACTTTCAGATACCTATAGTGCAGAAAAACAATTAACCAAGGCTCTTTCTAAACTAGCCAGAGCCACGTCCAATGAAAAATTAAGCCAGGCCTTTCAATCTCATCTTGAAGAAACCCAGGGTCAGATTGAACGTATTGATCAGATCGTCGAATCTGAATCTGGCATTAAACTGAAAAGAATGAAATGCGTCGCTATGGAAGGGCTGATTGAAGAAGCCAATGAAGTCATCGAAAGTACGGAGAAAAACGAAGTACGCGATGCAGCGCTTATCGCCGCGGCGCAAAAAGTCGAGCATTACGAAATCGCCAGCTACGGCACGCTTGCCACCCTGGCCGAGCAGCTCGGCTATAGCAAAGCATTAAAACTGCTCAAAGAAACCCTCGACGAGGAAAACAAACTGATTTAAAACTTACCGATTTAGCAGTCAGCAATGTTAATAAAAGTGCTGAACGCAAATCGAAATAA (SEQ ID NO: 317) |
| 34_ATCCBAA-1738_Thompson | |
| 35_ATCC9712_Saintpaul | |
| 36_jfrlSe1402-1_Infantis | |
| 38_jfrlSe1402-3_Brandenburg | |
| 39_jfrlSe1402-4_Infantis | |
| 40_jfrlSe1402-5_Brandenburg | |
| 41_jfrlSe1402-6_Rissen | |
| 42_jfrlSe1402-7_Orion | |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | ATGAATATCAAAACCGTTGAAGACCTTTTTATCCATCTACTTTCAGATACCTATAGTGCAGAAAAACAATTAACCAAGGCTCTTCCTAAACTTGCCAGAGCCACGTCCAATGAAAAATTAAGCCAGGCCTTTCAATCTCATCTTGAAGAAACCCAGGGTCAGATTGAACGTATTGATCAGATCGTCGAATCTGAATCTGGCATTAAACTGAAAAGAATGAAATGCGTCGCTATGGAAGGGCTGATTGAAGAAGCCAATGAAGTCATCGAAAGTACGGAGAAAAACGAAGTACGCGATGCAGCGCTTATCGCCGCGGCGCAAAAAGTCGAGCATTACGAAATCGCCAGCTACGGCACGCTAGCCACCCTGGCCGAGCAGCTCGGCTATAGCAAAGCATTAAAACTGCTCAAAGAAACCCTCGACGAGGAAAACAAACTGATTTAAAACTTACCGATTTAGCAGTCAGCAATGTTAATAAAAGTGCTGAACGCAAATCGAAATAA (SEQ ID NO: 434) |
| 49_jfrlSe1402-14_Mbandaka | |
| 50_jfrlSe1402-15_Orion | |
| 51_jfrlSe1409-1_Altona | |
| 52_jfrlSe1409-2_Istanbul | |
| 53_jfrlSe1409-3_Senftenberg | ATGAATATCAAAACCGTTGAAGACCTTTTTATCCATCTACTTTCAGATACCTATAGTGCAGAAAAACAATTAACCAAGGCTCTTCCTAAACTTGCCAGAGCCACGTCCAATGAAAAATTAAGCCAGGCCTTTCAATCTCATCTTGAAGAAACCCAGGGTCAGATTGAACGTATTGATCAGATCGTCGAATCTGAATCTGGCATTAAACTGAAAAGAATGAAATGCGTCGCTATGGAAGGGCTGATTGAAGAAGCCAATGAAGTCATCGAAAGTACGGAGAAAAACGAAGTACGCGATGCAGCGCTTATCGCCGCGGCGCAAAAAGTCGAGCATTACGAAATCGCCGCTATGGCACGCTAGCCACCCTGGCCGAGCAGCTCGGCTATGCAAGGCATTAAAACTGCTTAAAGAAACCCTCGACGAGGAAAACAAACTGATTTAAAACTTACCGATTTAGCAGTCAGCAATGTTAATAAAAGTGCTGAACGCAAATCGAAATAA (SEQ ID NO: 474) |
| 54_jfrlSe1409-4_UN_O13 | |
| 55_jfrlSe1409-5_UN_O1,3,19 | |
| 56_jfrlSe1409-6_Montevideo | |
| 57_jfrlSe1409-7_UN_O1,3,19 | |
| 58_jfrlSe1409-8_UN_O18 | |
| 61_jfrlSe1409-11_UN_O1,3,19 | |
| 67_jfrlSe1409-17_Rissen | |
| 71_jfrlSe1409-21_Amsterdam | |

Fig. 35B

| | |
|---|---|
| 80_HySe09_Enteritidis | |
| 100_HySe29_Schwarzengrund | |
| 103_HySe32_Schwarzengrund | |
| 106_HySe35_Schwarzengrund | |

Fig. 36A

| | SOD |
|---|---|
| 01_NBRC13245T_Typhimurium | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:576) |
| 02_GTC00131_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:588) |
| 03_GTC09491_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:597) |
| 04_GTC03838_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:604) |
| 05_GTC08914_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:611) |
| 06_GTC09421_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:621) |
| 07_GTC09489_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:630) |
| 08_NBRC3163_Pullorum_Gallinarum | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:637) |
| 09_NBRC3313_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:647) |
| 10_NBRC12529_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:654) |
| 11_NBRC14193_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:661) |
| 12_NBRC14194_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:668) |
| 13_NBRC14209_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:675) |
| 14_NBRC14210_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:682) |
| 15_NBRC14211_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:689) |
| 16_NBRC14212_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:695) |
| 17_NBRC15181_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:702) |
| 18_NBRC15182_Minnesota | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:712) |
| 19_NBRC15183_Minnesota | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:722) |
| 20_NBRC15184_Minnesota | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:729) |
| 21_NBRC15185_Minnesota | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:736) |
| 22_NBRC15186_Minnesota | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:743) |
| 23_NBRC15187_Minnesota | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:750) |
| 24_NBRC100797_Abony | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:757) |
| 25_NBRC105684_Choleraesuis | MSYTLPSLPYAYDALEPHFDKQTMAIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:767) |
| 26_NBRC105726_Typhimurium | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:777) |
| 27_JCM3919_UN_O7_ | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:786) |
| 28_NBRC15335_Minnesota | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:793) |
| 29_GTC09490_Enteritidis | MSYTLPSLPYAYDALEPHFDKQTMEIHHTKHHQTYVNNANAALENLPEFADLPVEELITKLDQVPADKKTVLRNNAGGHANHSFFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:800) |

Fig. 36B

| | |
|---|---|
| 30_GTC09492_Braenderup | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAVSGASGFPILGLDVWEHAYYLKFQNRRPD YIKEFWNVVNWDEAAARFAAKK (SEQ ID NO:807) |
| 31_GTC09493_Pakistan | MSYTLPSLPYAYDALEPHFDKQTMEIHHTKHHQTYVNNANAALENLPEFADLPVEELITKLDQVPADKKTVLRNNAGGHANHSFFWKGLKKG STLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:814) |
| 32_GTC09549_Typhimurium | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:821) |
| 33_ATCCBAA-1675_Infantis | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:828) |
| 34_ATCCBAA-1738_Thompson | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:839) |
| 35_ATCC9712_Saintpaul | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:849) |
| 36_jfrlSe1402-1_Infantis | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:860) |
| 38_jfrlSe1402-3_Brandenburg | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:870) |
| 39_jfrlSe1402-4_Infantis | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:877) |
| 40_jfrlSe1402-5_Brandenburg | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:887) |
| 41_jfrlSe1402-6_Rissen | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:894) |
| 42_jfrlSe1402-7_Orion | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:901) |
| 43_jfrlSe1402-8_Rissen | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:911) |
| 44_jfrlSe1402-9_Rissen | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:918) |
| 45_jfrlSe1402-10_Rissen | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:925) |
| 46_jfrlSe1402-11_Rissen | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:932) |
| 47_jfrlSe1402-12_Rissen | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:939) |
| 48_jfrlSe1402-13_Mbandaka | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:946) |
| 49_jfrlSe1402-14_Mbandaka | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:956) |
| 50_jfrlSe1402-15_Orion | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:966) |
| 51_jfrlSe1409-1_Altona | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:976) |
| 52_jfrlSe1409-2_Istanbul | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:983) |
| 53_jfrlSe1409-3_Senftenberg | |
| 54_jfrlSe1409-4_UN_O13_ | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:996) |
| 55_jfrlSe1409-5_UN_O1,3,19_ | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1004) |
| 56_jfrlSe1409-6_Montevideo | MSYTLPSLPYAYDALEPHFDKQTMEIHHTKHHQTYVNNANAALENLPEFADLPAEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1013) |
| 57_jfrlSe1409-7_UN_O1,3,19_ | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1020) |
| 58_jfrlSe1409-8_UN_O18_ | MSYTLPSLPYAYDALEPHFDKQTMEIHHTKHHQTYVNNANAALENLPEFASLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1029) |
| 61_jfrlSe1409-11_UN_O1,3,19_ | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1038) |
| 67_jfrlSe1409-17_Rissen | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1047) |
| 71_jfrlSe1409-21_Amsterdam | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKVAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1055) |
| 80_HySe09_Enteritidis | MSYTLPSLPYAYDALEPHFDKQTMEIHHTKHHQTYVNNANAALENLPEFADLPVEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1065) |

Fig. 36C

| 100_HySe29_Schwarzengrund | MSYTLPSLPYAYDALEPHFDKQTMEIHHTKHHQTYVNNANAALENLPEFADLPAEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1075) |
|---|---|
| 103_HySe32_Schwarzengrund | MSYTLPSLPYAYDALEPHFDKQTMEIHHTKHHQTYVNNANAALENLPEFADLPAEELITKLDQVPADKKTVLRNNAGGHANHSLFWKGLKKG TTLQGDLKAAIERDFGSVDNFKAEFEKAAATRFGSGWAWLVLKGDKLAVVSTANQDSPLMGEAISGASGFPILGLDVWEHAYYLKFQNRRPD YIKEFWNVVNWDEAAARFAAKK (SEQ ID NO:1083) |
| 106_HySe35_Schwarzengrund | |

Fig. 37A

| | L17 |
|---|---|
| 01_NBRC13245T_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:577) |
| 02_GTC00131_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:589) |
| 03_GTC09491_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:598) |
| 04_GTC03838_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:605) |
| 05_GTC08914_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:612) |
| 06_GTC09421_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:622) |
| 07_GTC09489_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:631) |
| 08_NBRC3163_Pullorum_Gallinarum | MRHRKSGRQLNRNSSHRQAMFRNMAGSLVRHEIIKTTLPKAKELRRVVEPLITLAKTDSVANRRLAFARTRDNEIVAKLFN DLGPRFASRAGGYTRILKCGFRAGDNAPMAYIELVDRSEKTEAAAE (SEQ ID NO:638) |
| 09_NBRC3313_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:648) |
| 10_NBRC12529_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:655) |
| 11_NBRC14193_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:662) |
| 12_NBRC14194_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:669) |
| 13_NBRC14209_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:676) |
| 14_NBRC14210_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:683) |
| 15_NBRC14211_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:690) |
| 16_NBRC14212_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:696) |
| 17_NBRC15181_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:703) |
| 18_NBRC15182_Minnesota | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:713) |
| 19_NBRC15183_Minnesota | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:723) |
| 20_NBRC15184_Minnesota | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:730) |
| 21_NBRC15185_Minnesota | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:737) |
| 22_NBRC15186_Minnesota | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:744) |
| 23_NBRC15187_Minnesota | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:751) |
| 24_NBRC100797_Abony | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:758) |
| 25_NBRC105684_Choleraesuis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:768) |
| 26_NBRC105726_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:778) |
| 27_JCM3919_UN_O7_ | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:787) |
| 28_NBRC15335_Minnesota | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:794) |
| 29_GTC09490_Enteritidis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:801) |
| 30_GTC09492_Braenderup | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:808) |
| 31_GTC09493_Pakistan | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:815) |
| 32_GTC09549_Typhimurium | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:822) |
| 33_ATCCBAA-1675_Infantis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:829) |
| 34_ATCCBAA-1738_Thompson | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:840) |
| 35_ATCC9712_Saintpaul | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:850) |
| 36_jfrlSe1402-1_Infantis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:861) |
| 38_jfrlSe1402-3_Brandenburg | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:871) |
| 39_jfrlSe1402-4_Infantis | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:878) |
| 40_jfrlSe1402-5_Brandenburg | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:888) |
| 41_jfrlSe1402-6_Rissen | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:895) |
| 42_jfrlSe1402-7_Orion | MRHRKSGRQLNRNSSHRQAMFRNMAGSLVRHEIIKTTLPKAKELRRVVEPLITLAKTDSVANRRLAFARTRDNEIVAKLFN ELGPRFASRAGGYTRILKCGFRAGDNAPMAYIELVDRSEKTEAAAE (SEQ ID NO:902) |

Fig. 37B

| | |
|---|---|
| 43_jfrlSe1402-8_Rissen | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:912) |
| 44_jfrlSe1402-9_Rissen | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:919) |
| 45_jfrlSe1402-10_Rissen | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:926) |
| 46_jfrlSe1402-11_Rissen | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:933) |
| 47_jfrlSe1402-12_Rissen | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:940) |
| 48_jfrlSe1402-13_Mbandaka | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:947) |
| 49_jfrlSe1402-14_Mbandaka | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:957) |
| 50_jfrlSe1402-15_Orion | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:967) |
| 51_jfrlSe1409-1_Altona | |
| 52_jfrlSe1409-2_Istanbul | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:984) |
| 53_jfrlSe1409-3_Senftenberg | |
| 54_jfrlSe1409-4_UN_O13_ | |
| 55_jfrlSe1409-5_UN_O1,3,19_ | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1005) |
| 56_jfrlSe1409-6_Montevideo | |
| 57_jfrlSe1409-7_UN_O1,3,19_ | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1021) |
| 58_jfrlSe1409-8_UN_O18_ | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1030) |
| 61_jfrlSe1409-11_UN_O1,3,19_ | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1039) |
| 67_jfrlSe1409-17_Rissen | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1048) |
| 71_jfrlSe1409-21_Amsterdam | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1056) |
| 80_HySe09_Enteritidis | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1066) |
| 100_HySe29_Schwarzengrund | MKEEKPEFDPICCACRSGIYWSALLTASRQKLSTISVIWYSVPRLSFLRRLTWVKNLLPRLKTCWLPVDCLWVCAWKTGHRQASLTSNRITGGFTEKDKVMRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAESVVTKNPLRRVFLYPPEPHVSTIIVFFSX (SEQ ID NO:1076) |
| 103_HySe32_Schwarzengrund | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1084) |
| 106_HySe35_Schwarzengrund | MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE (SEQ ID NO:1090) |

Fig. 38A

| | L21 |
|---|---|
| 01_NBRC13245T_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:578) |
| 02_GTC00131_Enteritidis | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:590) |
| 03_GTC09491_Enteritidis | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:599) |
| 04_GTC03838_Enteritidis | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:606) |
| 05_GTC08914_Enteritidis | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:613) |
| 06_GTC09421_Enteritidis | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:623) |
| 07_GTC09489_Enteritidis | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:632) |
| 08_NBRC3163_Pullorum_Gallinarum | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:639) |
| 09_NBRC3313_Enteritidis | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:649) |
| 10_NBRC12529_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:656) |
| 11_NBRC14193_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:663) |
| 12_NBRC14194_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:670) |
| 13_NBRC14209_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:677) |
| 14_NBRC14210_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:684) |
| 15_NBRC14211_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:691) |
| 16_NBRC14212_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:697) |
| 17_NBRC15181_Typhimurium | MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA (SEQ ID NO:704) |
| 18_NBRC15182_Minnesota | MYAVFQSGGKQHRVSEGQTVRLEKLDIATGETIEFAEVLMVANGEEVKIGVPFVDGGVIKAEVVAHGRGEKVKIVKFRRRKHYRKQQGHRQWFTDVKITGISA (SEQ ID NO:714) |
| 19_NBRC15183_Minnesota | MYAVFQSGGKQHRVSEGQTVRLEKLDIATGETIEFAEVLMVANGEEVKIGVPFVDGGVIKAEVVAHGRGEKVKIVKFRRRKHYRKQQGHRQWFTDVKITGISA (SEQ ID NO:724) |
| 20_NBRC15184_Minnesota | MYAVFQSGGKQHRVSEGQTVRLEKLDIATGETIEFAEVLMVANGEEVKIGVPFVDGGVIKAEVVAHGRGEKVKIVKFRRRKHYRKQQGHRQWFTDVKITGISA (SEQ ID NO:731) |
| 21_NBRC15185_Minnesota | MYAVFQSGGKQHRVSEGQTVRLEKLDIATGETIEFAEVLMVANGEEVKIGVPFVDGGVIKAEVVAHGRGEKVKIVKFRRRKHYRKQQGHRQWFTDVKITGISA (SEQ ID NO:738) |
| 22_NBRC15186_Minnesota | MYAVFQSGGKQHRVSEGQTVRLEKLDIATGETIEFAEVLMVANGEEVKIGVPFVDGGVIKAEVVAHGRGEKVKIVKFRRRKHYRKQQGHRQWFTDVKITGISA (SEQ ID NO:745) |
| 23_NBRC15187_Minnesota | MYAVFQSGGKQHRVSEGQTVRLEKLDIATGETIEFAEVLMVANGEEVKIGVPFVDGGVIKAEVVAHGRGEKVKIVKFRRRKHYRKQQGHRQWFTDVKITGISA (SEQ ID NO:752) |

Fig. 38B

| | |
|---|---|
| 24_NBRC100797_Abony | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:759) |
| 25_NBRC105684_Choleraesuis | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:769) |
| 26_NBRC105726_Typhimurium | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:779) |
| 27_JCM3919_UN_O7_ | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:788) |
| 28_NBRC15335_Minnesota | MYAVFQSGGKQHRVSEGQTVRLEKLDIATGETIEFAEVLMVANGEEVKIGVPFVDGGVIKAEVVAHGRGEKVKIVKFR RRKHYRKQQGHRQWFTDVKITGISA (SEQ ID NO:795) |
| 29_GTC09490_Enteritidis | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:802) |
| 30_GTC09492_Braenderup | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:809) |
| 31_GTC09493_Pakistan | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:816) |
| 32_GTC09549_Typhimurium | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:823) |
| 33_ATCCBAA-1675_Infantis | MYAVFQSGGKQHRVSEGQTVRLEKLDIATGETIEFAEVLMVANGEEVKIGVPFVDGGVIKAEVVAHGRGEKVKIVKFR RRKHYRKQQGHRQWFTDVKITGISA (SEQ ID NO:830) |
| 34_ATCCBAA-1738_Thompson | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:841) |
| 35_ATCC9712_Saintpaul | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:851) |
| 36_jfrlSe1402-1_Infantis | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:862) |
| 38_jfrlSe1402-3_Brandenburg | MYAVFQSGGKQHRVSEGQTVRLEKLDIATGETIEFAEVLMVANGEEVKIGVPFVDGGVIKAEVVAHGRGEKVKIVKFR RRKHYRKQQGHRQWFTDVKITGISA (SEQ ID NO:872) |
| 39_jfrlSe1402-4_Infantis | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:879) |
| 40_jfrlSe1402-5_Brandenburg | MYAVFQSGGKQHRVSEGQTVRLEKLDIATGETIEFAEVLMVANGEEVKIGVPFVDGGVIKAEVVAHGRGEKVKIVKFR RRKHYRKQQGHRQWFTDVKITGISA (SEQ ID NO:889) |
| 41_jfrlSe1402-6_Rissen | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:896) |
| 42_jfrlSe1402-7_Orion | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:903) |
| 43_jfrlSe1402-8_Rissen | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:913) |
| 44_jfrlSe1402-9_Rissen | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:920) |
| 45_jfrlSe1402-10_Rissen | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:927) |
| 46_jfrlSe1402-11_Rissen | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:934) |
| 47_jfrlSe1402-12_Rissen | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:941) |
| 48_jfrlSe1402-13_Mbandaka | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:948) |
| 49_jfrlSe1402-14_Mbandaka | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:958) |
| 50_jfrlSe1402-15_Orion | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:968) |
| 51_jfrlSe1409-1_Altona | |
| 52_jfrlSe1409-2_Istanbul | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:985) |
| 53_jfrlSe1409-3_Senftenberg | |
| 54_jfrlSe1409-4_UN_O13_ | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:997) |
| 55_jfrlSe1409-5_UN_O1,3,19_ | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:1006) |
| 56_jfrlSe1409-6_Montevideo | MYAVFQSGGKQHRVSEGQTVRLEKLDIATGETIEFAEVLMVANGEEVKIGVPFVDGGVIKAEVVAHGRGEKVKIVKFR RRKHYRKQQGHRQWFTDVKITGISA (SEQ ID NO:1014) |
| 57_jfrlSe1409-7_UN_O1,3,19_ | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:1022) |
| 58_jfrlSe1409-8_UN_O18_ | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:1031) |
| 61_jfrlSe1409-11_UN_O1,3,19_ | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:1040) |
| 67_jfrlSe1409-17_Rissen | |
| 71_jfrlSe1409-21_Amsterdam | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:1057) |
| 80_HySe09_Enteritidis | MYAVFQSGGKQHRVSEGQTVRLEKLDIATGETIEFAEVLMIANGEEVKIGVPFVDGGVIKAEVVAHGRGEKVKIVKFR RRKHYRKQQGHRQWFTDVKITGISA (SEQ ID NO:1067) |
| 100_HySe29_Schwarzengrund | MYAVFQSGGKQHRVSEGQTVRLEKLDIATGETIEFAEVLMVANGEEVKIGVPFVDGGVIKAEVVAHGRGEKVKIVKFR RRKHYRKQQGHRQWFTDVKITGISA (SEQ ID NO:1077) |
| 103_HySe32_Schwarzengrund | |
| 106_HySe35_Schwarzengrund | |

Fig. 39A

| | S8 |
|---|---|
| 01_NBRC13245T_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:579) |
| 02_GTC00131_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:591) |
| 03_GTC09491_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:600) |
| 04_GTC03838_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:607) |
| 05_GTC08914_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:614) |
| 06_GTC09421_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:624) |
| 07_GTC09489_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:633) |
| 08_NBRC3163_Pullorum_Gallinarum | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:640) |
| 09_NBRC3313_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:650) |
| 10_NBRC12529_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:657) |
| 11_NBRC14193_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:664) |
| 12_NBRC14194_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:671) |
| 13_NBRC14209_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:678) |
| 14_NBRC14210_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:685) |
| 15_NBRC14211_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:692) |
| 16_NBRC14212_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:698) |
| 17_NBRC15181_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:705) |
| 18_NBRC15182_Minnesota | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:715) |
| 19_NBRC15183_Minnesota | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:725) |
| 20_NBRC15184_Minnesota | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:732) |
| 21_NBRC15185_Minnesota | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:739) |
| 22_NBRC15186_Minnesota | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:746) |
| 23_NBRC15187_Minnesota | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:753) |
| 24_NBRC100797_Abony | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:760) |
| 25_NBRC105684_Choleraesuis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:770) |
| 26_NBRC105726_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:780) |
| 27_JCM3919_UN_O7_ | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:789) |
| 28_NBRC15335_Minnesota | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:796) |
| 29_GTC09490_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:803) |
| 30_GTC09492_Braenderup | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:810) |
| 31_GTC09493_Pakistan | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:818) |
| 32_GTC09549_Typhimurium | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:824) |
| 33_ATCCBAA-1675_Infantis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:831) |
| 34_ATCCBAA-1738_Thompson | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:842) |
| 35_ATCC9712_Saintpaul | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:852) |
| 36_jfrlSe1402-1_Infantis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:863) |
| 38_jfrlSe1402-3_Brandenburg | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:873) |
| 39_jfrlSe1402-4_Infantis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:880) |
| 40_jfrlSe1402-5_Brandenburg | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:890) |
| 41_jfrlSe1402-6_Rissen | MSMQDPIADMLTRIRNGQAANKAAVTMPSSKLKVAIANVLKEEGFIEDFKVEGDTKPELELILKYFQGKAVVESI QRVSRPGLRIYKRKDELPKVMAGLGIAVVSTSKGVMTDRAARQAGLGGEIICYVA (SEQ ID NO:897) |
| 42_jfrlSe1402-7_Orion | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:904) |
| 43_jfrlSe1402-8_Rissen | MSMQDPIADMLTRIRNGQAANKAAVTMPSSKLKVAIANVLKEEGFIEDFKVEGDTKPELELILKYFQGKAVVESI QRVSRPGLRIYKRKDELPKVMAGLGIAVVSTSKGVMTDRAARQAGLGGEIICYVA (SEQ ID NO:914) |
| 44_jfrlSe1402-9_Rissen | MSMQDPIADMLTRIRNGQAANKAAVTMPSSKLKVAIANVLKEEGFIEDFKVEGDTKPELELILKYFQGKAVVESI QRVSRPGLRIYKRKDELPKVMAGLGIAVVSTSKGVMTDRAARQAGLGGEIICYVA (SEQ ID NO:921) |
| 45_jfrlSe1402-10_Rissen | MSMQDPIADMLTRIRNGQAANKAAVTMPSSKLKVAIANVLKEEGFIEDFKVEGDTKPELELILKYFQGKAVVESI QRVSRPGLRIYKRKDELPKVMAGLGIAVVSTSKGVMTDRAARQAGLGGEIICYVA (SEQ ID NO:928) |

Fig. 39B

| | |
|---|---|
| 46_jfrlSe1402-11_Rissen | MSMQDPIADMLTRIRNGQAANKAAVTMPSSKLKVAIANVLKEEGFIEDFKVEGDTKPELELILKYFQGKAVVESI QRVSRPGLRIYKRKDELPKVMAGLGIAVVSTSKGVMTDRAARQAGLGGEIICYVA (SEQ ID NO:935) |
| 47_jfrlSe1402-12_Rissen | MSMQDPIADMLTRIRNGQAANKAAVTMPSSKLKVAIANVLKEEGFIEDFKVEGDTKPELELILKYFQGKAVVESI QRVSRPGLRIYKRKDELPKVMAGLGIAVVSTSKGVMTDRAARQAGLGGEIICYVA (SEQ ID NO:942) |
| 48_jfrlSe1402-13_Mbandaka | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:949) |
| 49_jfrlSe1402-14_Mbandaka | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:959) |
| 50_jfrlSe1402-15_Orion | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:969) |
| 51_jfrlSe1409-1_Altona | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:977) |
| 52_jfrlSe1409-2_Istanbul | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:986) |
| 53_jfrlSe1409-3_Senftenberg | |
| 54_jfrlSe1409-4_UN_O13_ | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:998) |
| 55_jfrlSe1409-5_UN_O1,3,19_ | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1007) |
| 56_jfrlSe1409-6_Montevideo | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1015) |
| 57_jfrlSe1409-7_UN_O1,3,19_ | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1023) |
| 58_jfrlSe1409-8_UN_O18_ | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1032) |
| 61_jfrlSe1409-11_UN_O1,3,19_ | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1041) |
| 67_jfrlSe1409-17_Rissen | MSMQDPIADMLTRIRNGQAANKAAVTMPSSKLKVAIANVLKEEGFIEDFKVEGDTKPELELILKYFQGKAVVESI QRVSRPGLRIYKRKDELPKVMAGLGIAVVSTSKGVMTDRAARQAGLGGEIICYVA (SEQ ID NO:1049) |
| 71_jfrlSe1409-21_Amsterdam | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1058) |
| 80_HySe09_Enteritidis | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1068) |
| 100_HySe29_Schwarzengrund | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1078) |
| 103_HySe32_Schwarzengrund | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1085) |
| 106_HySe35_Schwarzengrund | MSMQDPIADMLTRIRNGQAANKAAVTMPSSKLKVAIANVLKEEGFIEDFKVEGDTKPELELTLKYFQGKAVVESI QRVSRPGLRIYKRKDELPKVMAGLGIAVVSTSKGVMTDRAARQAGLGGEIICYVA (SEQ ID NO:1091) |

Fig. 40A

| | L15 |
|---|---|
| 01_NBRC13245T_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:580) |
| 02_GTC00131_Enteritidis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:592) |
| 03_GTC09491_Enteritidis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:601) |
| 04_GTC03838_Enteritidis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:608) |
| 05_GTC08914_Enteritidis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:615) |
| 06_GTC09421_Enteritidis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:625) |
| 07_GTC09489_Enteritidis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:634) |
| 08_NBRC3163_Pullorum_Gallinarum | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:641) |
| 09_NBRC3313_Enteritidis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:651) |
| 10_NBRC12529_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:658) |
| 11_NBRC14193_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:665) |
| 12_NBRC14194_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:672) |
| 13_NBRC14209_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:679) |
| 14_NBRC14210_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:686) |
| 15_NBRC14211_Typhimurium | |
| 16_NBRC14212_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:699) |
| 17_NBRC15181_Typhimurium | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:706) |
| 18_NBRC15182_Minnesota | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:716) |
| 19_NBRC15183_Minnesota | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:726) |
| 20_NBRC15184_Minnesota | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:733) |
| 21_NBRC15185_Minnesota | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:740) |
| 22_NBRC15186_Minnesota | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:747) |
| 23_NBRC15187_Minnesota | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:754) |
| 24_NBRC100797_Abony | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:761) |
| 25_NBRC105684_Choleraesuis | MRLNTLSPAEGSKKAGKRLGRGIGSGLGKTGGRGHKGQKSRSGGGVRRGFEGGQMPLYRRLPKFGFTSRKAAITAEVR LSDLAKVEGGVVDLNTLKAANIIGIQIEFAKVILAGEVTTPVTVRGLRVTKGARAAIEAAGGKIEE (SEQ ID NO:771) |

Fig. 40B

| | |
|---|---|
| 26_NBRC105726_Typhimurium | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTIRGLRVTKGARAAIEAAGGKIEE (SEQ ID NO:781) |
| 27_JCM3919_UN_O7_ | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:790) |
| 28_NBRC15335_Minnesota | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:797) |
| 29_GTC09490_Enteritidis | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:804) |
| 30_GTC09492_Braenderup | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:811) |
| 31_GTC09493_Pakistan | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:819) |
| 32_GTC09549_Typhimurium | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:825) |
| 33_ATCCBAA-1675_Infantis | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:832) |
| 34_ATCCBAA-1738_Thompson | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:843) |
| 35_ATCC9712_Saintpaul | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:853) |
| 36_jfrlSe1402-1_Infantis | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:864) |
| 38_jfrlSe1402-3_Brandenburg | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:874) |
| 39_jfrlSe1402-4_Infantis | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:881) |
| 40_jfrlSe1402-5_Brandenburg | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:891) |
| 41_jfrlSe1402-6_Rissen | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:898) |
| 42_jfrlSe1402-7_Orion | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:905) |
| 43_jfrlSe1402-8_Rissen | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:915) |
| 44_jfrlSe1402-9_Rissen | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:922) |
| 45_jfrlSe1402-10_Rissen | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:929) |
| 46_jfrlSe1402-11_Rissen | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:936) |
| 47_jfrlSe1402-12_Rissen | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:943) |
| 48_jfrlSe1402-13_Mbandaka | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:950) |
| 49_jfrlSe1402-14_Mbandaka | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:960) |
| 50_jfrlSe1402-15_Orion | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:970) |
| 51_jfrlSe1409-1_Altona | MHLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:978) |
| 52_jfrlSe1409-2_Istanbul | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:987) |
| 53_jfrlSe1409-3_Senftenberg | |
| 54_jfrlSe1409-4_UN_O13_ | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:999) |
| 55_jfrlSe1409-5_UN_O1,3,19_ | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1008) |
| 56_jfrlSe1409-6_Montevideo | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1016) |
| 57_jfrlSe1409-7_UN_O1,3,19_ | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1024) |
| 58_jfrlSe1409-8_UN_O18_ | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1033) |
| 61_jfrlSe1409-11_UN_O1,3,19_ | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1042) |
| 67_jfrlSe1409-17_Rissen | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1050) |
| 71_jfrlSe1409-21_Amsterdam | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1059) |
| 80_HySe09_Enteritidis | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1069) |
| 100_HySe29_Schwarzengrund | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1079) |
| 103_HySe32_Schwarzengrund | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1086) |
| 106_HySe35_Schwarzengrund | MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE (SEQ ID NO:1092) |

Fig. 41A

| | S7 |
|---|---|
| 01_NBRC13245T_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:581) |
| 02_GTC00131_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:593) |
| 03_GTC09491_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:602) |
| 04_GTC03838_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:609) |
| 05_GTC08914_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:616) |
| 06_GTC09421_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:626) |
| 07_GTC09489_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:635) |
| 08_NBRC3163_Pullorum_Gallinarum | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:642) |
| 09_NBRC3313_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:652) |
| 10_NBRC12529_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:659) |
| 11_NBRC14193_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:666) |
| 12_NBRC14194_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:673) |
| 13_NBRC14209_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:680) |
| 14_NBRC14210_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:687) |
| 15_NBRC14211_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:693) |
| 16_NBRC14212_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:700) |
| 17_NBRC15181_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:707) |
| 18_NBRC15182_Minnesota | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:717) |
| 19_NBRC15183_Minnesota | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:727) |
| 20_NBRC15184_Minnesota | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:734) |
| 21_NBRC15185_Minnesota | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:741) |
| 22_NBRC15186_Minnesota | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:748) |
| 23_NBRC15187_Minnesota | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:755) |
| 24_NBRC100797_Abony | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:762) |
| 25_NBRC105684_Choleraesuis | MPRRRVIGQRKILPDPKFGSELLAKFVNILMVDGKKSTAESIAYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:772) |
| 26_NBRC105726_Typhimurium | |
| 27_JCM3919_UN_O7_ | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:791) |
| 28_NBRC15335_Minnesota | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:798) |
| 29_GTC09490_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:805) |
| 30_GTC09492_Braenderup | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:812) |
| 31_GTC09493_Pakistan | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:820) |
| 32_GTC09549_Typhimurium | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:826) |
| 33_ATCCBAA-1675_Infantis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:833) |
| 34_ATCCBAA-1738_Thompson | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:844) |
| 35_ATCC9712_Saintpaul | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:854) |
| 36_jfrlSe1402-1_Infantis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:865) |
| 38_jfrlSe1402-3_Brandenburg | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:875) |
| 39_jfrlSe1402-4_Infantis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:882) |
| 40_jfrlSe1402-5_Brandenburg | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:892) |
| 41_jfrlSe1402-6_Rissen | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:899) |
| 42_jfrlSe1402-7_Orion | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:906) |
| 43_jfrlSe1402-8_Rissen | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:916) |
| 44_jfrlSe1402-9_Rissen | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:923) |
| 45_jfrlSe1402-10_Rissen | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:930) |
| 46_jfrlSe1402-11_Rissen | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:937) |
| 47_jfrlSe1402-12_Rissen | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:944) |
| 48_jfrlSe1402-13_Mbandaka | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:951) |

Fig. 41B

| | |
|---|---|
| 49_jfrlSe1402-14_Mbandaka | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:961) |
| 50_jfrlSe1402-15_Orion | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAADNKGTAVKKREDVHRMAEANKAFAHYRW (SEQ ID NO:971) |
| 51_jfrlSe1409-1_Altona | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:979) |
| 52_jfrlSe1409-2_Istanbul | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:988) |
| 53_jfrlSe1409-3_Senftenberg | |
| 54_jfrlSe1409-4_UN_O13_ | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1000) |
| 55_jfrlSe1409-5_UN_O1,3,19_ | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1009) |
| 56_jfrlSe1409-6_Montevideo | |
| 57_jfrlSe1409-7_UN_O1,3,19_ | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1025) |
| 58_jfrlSe1409-8_UN_O18_ | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1034) |
| 61_jfrlSe1409-11_UN_O1,3,19_ | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1043) |
| 67_jfrlSe1409-17_Rissen | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1051) |
| 71_jfrlSe1409-21_Amsterdam | MATVNQLVRKPRARKVAKSNVPALEACPQKRGVCTRVYTTTPKKPNSALRKVCRVRLTNGFEVTSYIGGEGHNLQEHSVILIRGGR VKDLPGVRYHTVRGALDCSGVKDRKQARSKYGVKRPKA (SEQ ID NO:1060) |
| 80_HySe09_Enteritidis | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1070) |
| 100_HySe29_Schwarzengrund | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1080) |
| 103_HySe32_Schwarzengrund | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1087) |
| 106_HySe35_Schwarzengrund | MPRRRVIGQRKILPDPKFGSELLAKFVNILMVDGKKSTAESIVYSALETLAQRSGKSELEAFEVALENVRPTVEVKSRRVGGSTYQVP VEVRPVRRNALAMRWIVEAARKRGDKSMALRLANELSDAAENKGTAVKKREDVHRMAEANKAFAHYRW (SEQ ID NO:1093) |

Fig.42

| | gns |
|---|---|
| 01_NBRC13245T_Typhimurium | MNSEELTHKAEEEIAALISKKVAELRKKTGQEVSEIEFAPRETMKGLEGYHVKIKLL (SEQ ID NO:582) |
| 02_GTC00131_Enteritidis | |
| 03_GTC09491_Enteritidis | |
| 04_GTC03838_Enteritidis | |
| 05_GTC08914_Enteritidis | MNSEELTHKAEEEIAALISKKVAELRKKTGQEVSEIEFAPRETMKGLEGYHVKIKLL (SEQ ID NO:617) |
| 06_GTC09421_Enteritidis | MNSEELTHKAEEEIAALISKKVAELRKKTGQEVSEIEFAPRETMKGLEGYHVKIKLL (SEQ ID NO:627) |
| 07_GTC09489_Enteritidis | |
| 08_NBRC3163_Pullorum_Gallinarum | MNSEELTHKAEEEIAALISKKVAELRKKTGQEVSEIEFAPRETMKGLEGYHVKIKLL (SEQ ID NO:643) |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | MNSEELTHKAEEEIAALISKKVAELRKKTGQEVSEIEFVPRETMKGLEGYHVKIKLL (SEQ ID NO:708) |
| 18_NBRC15182_Minnesota | MNSEELTHKAEEEIAALISKKVAELRKKTGQEVSEIEFAPRETMKGLEGYHVKIKLL (SEQ ID NO:718) |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | MNSEELTHKAEEEIAALISKKVAELRKKTGQEVSEIEFAPRETMKGLEGYHVKIKLL (SEQ ID NO:763) |
| 25_NBRC105684_Choleraesuis | MNSEELTHKAEEEIAALISKKVAELRKKTGQEVSEIEFAPRETMKGLEGYHVKIKLL (SEQ ID NO:773) |
| 26_NBRC105726_Typhimurium | MNSEELTHKAEEEIAALISKKVAELRKKTGQEVSEIEFAPRETMKGLEGYHVKIKLL (SEQ ID NO:782) |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | MNSEELTHKAEEEIAALISKKVAELRKKTGQEVSEIEFAPRETMKGLEGYHVKIKLL (SEQ ID NO:834) |
| 34_ATCCBAA-1738_Thompson | MNSEELTHKAEEEIAALISKKVAELRKKTGQEVSEIEFAPRETMKGLEGYHVKIKLL (SEQ ID NO:845) |
| 35_ATCC9712_Saintpaul | MNSEELTHKAEEEIAALISKKVAELRKKTGQEVSEIEFAPRETMKGLEGYHVKIKLL (SEQ ID NO:855) |
| 36_jfrlSe1402-1_Infantis | MNSEELTHKAEEEIAALISKKVAELRKKTGQEVSEIEFVPRETMKGLEGYHVKIKLL (SEQ ID NO:866) |
| 38_jfrlSe1402-3_Brandenburg | |
| 39_jfrlSe1402-4_Infantis | MNSEELTHKAEEEIAALISKKVAELRKKTGQEVSEIEFVPRETMKGLEGYHVKIKLL (SEQ ID NO:883) |
| 40_jfrlSe1402-5_Brandenburg | |
| 41_jfrlSe1402-6_Rissen | |
| 42_jfrlSe1402-7_Orion | MNSEELTHKAEEEIAALISKKVAELRKKTGQEVSEIEFAPRETMKGLEGYHVKIKLL (SEQ ID NO:907) |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | MNSEELTHKAEEEIAALISKKVAELRKKTGQEVSEIEFVPRETMKGLEGYHVKIKLL (SEQ ID NO:952) |
| 49_jfrlSe1402-14_Mbandaka | MNSEELTHKAEEEIAALISKKVAELRKKTGQEVSEIEFVPRETMKGLEGYHVKIKLL (SEQ ID NO:962) |
| 50_jfrlSe1402-15_Orion | MNSEELTHKAEEEIAALISKKVAELRKKTGQEVSEIEFAPRETMKGLEGYHVKIKLL (SEQ ID NO:972) |
| 51_jfrlSe1409-1_Altona | MNSEELTHKAEEEIAALISKKVAELRKKTGQEVSEIEFAPRETMKGLEGYHVKIKLL (SEQ ID NO:980) |
| 52_jfrlSe1409-2_Istanbul | MNSEELTHKAEEEIAALISKKVAELRKKTGQEVSEIEFVPRETMKGLEGYHVKIKLL (SEQ ID NO:989) |
| 53_jfrlSe1409-3_Senftenberg | MNSEELTHKAEEEIAALISKKVAELRKKTGQEVSEIEFVPRETMKGLEGYHVKIKLL (SEQ ID NO:992) |
| 54_jfrlSe1409-4_UN_O13_ | MNSEELTHKAEEEIAALISKKVAELRKKTGQEVSEIEFVPRETMKGLEGYHVKIKLL (SEQ ID NO:1001) |
| 55_jfrlSe1409-5_UN_O1,3,19_ | MNSEELTHKAEEEIAALISKKVAELRKKTGQEVSEIEFVPRETMKGLEGYHVKIKLL (SEQ ID NO:1010) |
| 56_jfrlSe1409-6_Montevideo | MNSEELTHKAEEEIAALISKKVAELRKKTGQEVSEIEFVPRETMKGLEGYHVKIKLL (SEQ ID NO:1017) |
| 57_jfrlSe1409-7_UN_O1,3,19_ | MNSEELTHKAEEEIAALISKKVAELRKKTGQEVSEIEFVPRETMKGLEGYHVKIKLL (SEQ ID NO:1026) |
| 58_jfrlSe1409-8_UN_O18_ | MNSEELTHKAEEEIAALISKKVAELRKKTGQEVSEIEFVPRETMKGLEGYHVKIKLL (SEQ ID NO:1035) |
| 61_jfrlSe1409-11_UN_O1,3,19_ | MNSEELTHKAEEEIAALISKKVAELRKKTGQEVSEIEFVPRETMKGLEGYHVKIKLL (SEQ ID NO:1044) |
| 67_jfrlSe1409-17_Rissen | MNSEELTHKAEEEIAALISKKVAELRKKTGQEVSEIEFVPRETMKGLEGYHVKIKLL (SEQ ID NO:1052) |
| 71_jfrlSe1409-21_Amsterdam | MNSEELTHKAEEEIAALISKKVAELRKKTGQEVSEIEFVPRETMKGLEGYHVKIKLL (SEQ ID NO:1061) |
| 80_HySe09_Enteritidis | MNSEELTHKAEEEIAALISKKVAELRKKTGQEVSEIEFVPRETMKGLEGYHVKIKLL (SEQ ID NO:1071) |
| 100_HySe29_Schwarzengrund | MNSEELTHKAEEEIAALISKKVAELRKKTGQEVSEIEFAPRETMKGLEGYHVKIKLL (SEQ ID NO:1081) |
| 103_HySe32_Schwarzengrund | MNSEELTHKAEEEIAALISKKVAELRKKTGQEVSEIEFAPRETMKGLEGYHVKIKLL (SEQ ID NO:1088) |
| 106_HySe35_Schwarzengrund | MNSEELTHKAEEEIAALISKKVAELRKKTGQEVSEIEFAPRETMKGLEGYHVKIKLL (SEQ ID NO:1094) |

Fig.43

| | YibT |
|---|---|
| 01_NBRC13245T_Typhimurium | MAKIGENVPLLIDKAVDFMASSQAFREYLNKTPPRDYVPSEVPSESAPIYLQRLEYYRRLYRPKEEERG (SEQ ID NO:583) |
| 02_GTC00131_Enteritidis | |
| 03_GTC09491_Enteritidis | |
| 04_GTC03838_Enteritidis | |
| 05_GTC08914_Enteritidis | MAKIGENVPLLIDKAVDFMASSQAFREYLNKTPPRDYVPSEVPSESAPIYLQRLEYYRRLYRPKEEERG (SEQ ID NO:618) |
| 06_GTC09421_Enteritidis | MAKIGENVPLLIDKAVDFMASSQAFREYLNKTPPRDYVPSEVPSESAPIYLQRLEYYRRLYRPKEEERG (SEQ ID NO:628) |
| 07_GTC09489_Enteritidis | |
| 08_NBRC3163_Pullorum_Gallinarum | MAKIGENVPLLIDKAVDFKASSQAFREYLNKTPPRDYVPSEVPSESAPIYLQRLEYYRRLYRPKEEERG (SEQ ID NO:644) |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | MAKIGENVPLLIDKAVDFMASSQAFREYLNKTPPRDYVPSEVPSESAPIYLQRLEYYRRLYRPKEEERG (SEQ ID NO:709) |
| 18_NBRC15182_Minnesota | MAKIGENVPLLIDKAVDFMASSQAFREYLNKTPPRDYVPSEVPSESAPIYLQRLEYYRRLYRPKEEERG (SEQ ID NO:719) |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | MAKIGENVPLLIDKAVDFMASSQAFREYLNKTPPRDYVPSEVPSESAPIYLQRLEYYRRLYRPKEEERG (SEQ ID NO:764) |
| 25_NBRC105684_Choleraesuis | MAKIGENVPLLIDKAVDFMASSQAFREYLNKTPPRDYVPSEVPSESAPIYLQRLEYYRRLYRPKEEERG (SEQ ID NO:774) |
| 26_NBRC105726_Typhimurium | MAKIGENVPLLIDKAVDFMASSQAFREYLNKTPPRDYVPSEVPSESAPIYLQRLEYYRRLYRPKEEERG (SEQ ID NO:783) |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | MAKIGENVPLLIDKAVDFMASSQAFREYLNKTPPRDYVPSEVPSESAPIYLQRLEYYRRLYRPKEEERG (SEQ ID NO:835) |
| 34_ATCCBAA-1738_Thompson | MAKIGENVPLLIDKAVDFMASSQAFREYLNKTPPRDYVPSEVPSESAPIYLQRLEYYRRLYRPKEEERS (SEQ ID NO:846) |
| 35_ATCC9712_Saintpaul | MAKIGENVPLLIDKAVDFMASSQAFREYLNKTPPRDYVPSEVPSESAPIYLQRLAYYRRLYRPKEEERG (SEQ ID NO:856) |
| 36_jfrlSe1402-1_Infantis | MAKIGENVPLLIDKAVDFMASSQAFREYLNKTPPRDYVPSEVPSESAPIYLQRLEYYRRLYRPKEEERG (SEQ ID NO:867) |
| 38_jfrlSe1402-3_Brandenburg | |
| 39_jfrlSe1402-4_Infantis | MAKIGENVPLLIDKAVDFMASSQAFREYLNKTPPRDYVPSEVPSESAPIYLQRLEYYRRLYRPKEEERG (SEQ ID NO:884) |
| 40_jfrlSe1402-5_Brandenburg | |
| 41_jfrlSe1402-6_Rissen | |
| 42_jfrlSe1402-7_Orion | MAKIGENVPLLIDKAVDFMASSQAFREYLNKTPPRDYVPSEVPSESAPIYLQRLEYYRRLYRPKEEERG (SEQ ID NO:908) |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | |
| 49_jfrlSe1402-14_Mbandaka | MAKIGENVPLLIDKAVDFMASSQAFREYLNKTPPRDYVPSEVPSESAPIYLQRLEYYRRLYRPKEEERG (SEQ ID NO:963) |
| 50_jfrlSe1402-15_Orion | MAKIGENVPLLIDKAVDFMASSQAFREYLNKTPPRDYVPSEVPSESAPIYLQRLEYYRRLYRPKEEERG (SEQ ID NO:973) |
| 51_jfrlSe1409-1_Altona | MAKIGENVPLLIDKAVDFMASSQAFREYLNKTPPRDYVPSEVPSESAPIYLQRLEYYRRLYRPKEEERGRRDX (SEQ ID NO:981) |
| 52_jfrlSe1409-2_Istanbul | MAKIGENVPLLIDKAVDFMASSQAFREYLNKTPPRDYVPSEVPSESAPIYLQRLEYYRRLYRPKEERGRR (SEQ ID NO:990) |
| 53_jfrlSe1409-3_Senftenberg | MAKIGENVPLLIDKAVDFMASSQAFREYLNKTPPRDYVPSEVPSESAPIYLQRLAYYRRLYRPKEEERG (SEQ ID NO:993) |
| 54_jfrlSe1409-4_UN_O13_ | MAKIGENVPLLIDKAVDFMASSQAFREYLNKTPPRDYVPSEVPSESAPIYLQRLEYYRRLYRPKEEERG (SEQ ID NO:1002) |
| 55_jfrlSe1409-5_UN_O1,3,19_ | MAKIGENVPLLIDKAVDFMASSQAFREFKYKTPPRDYVPSEVPSESAPIYLQRLAYYRRLYRPKEEERG (SEQ ID NO:1011) |
| 56_jfrlSe1409-6_Montevideo | MAKIGENVPLLIDKAVDFMASSQAFREYLNKTPPRDYVPSEVPSESAPIYLQRLEYYRRLYRPKEEERG (SEQ ID NO:1018) |
| 57_jfrlSe1409-7_UN_O1,3,19_ | MAKIGENVPLLIDKAVDFMASSQAFREYLNKTPPRDYVPSEVPSESAPIYLQRLAYYRRLYRPKEEERG (SEQ ID NO:1027) |
| 58_jfrlSe1409-8_UN_O18_ | MAKIGENVPLLIDKAVDFMASSQAFREYLNKTPPRDYVPSEVPSESAPIYLQRLEYYRRLYRPKEEERG (SEQ ID NO:1036) |
| 61_jfrlSe1409-11_UN_O1,3,19_ | MAKIGENVPLLIDKAVDFMASSQAFREYLNKTPPRDYVPSEVPSESAPIYLQRLAYYRRLYRPKEEERG (SEQ ID NO:1045) |
| 67_jfrlSe1409-17_Rissen | MAKIGENVPLLIDKAVDFMASSQAFREYLNKTPPRDYVPSEVPSESAPIYLQRLEYYRRLYRPKEEERG (SEQ ID NO:1053) |
| 71_jfrlSe1409-21_Amsterdam | MAKIGENVPLLIDKAVDFMASSQAFREYLNKTPPRDYVPSEVPSESAPIYLQRLEYYRRLYRPKEEERG (SEQ ID NO:1062) |
| 80_HySe09_Enteritidis | MAKIGENVPLLIDKAVDFMASSQAFREYLNKTPPRDYVPSEVPSESAPIYLQRLEYYRRLYRPKEEERG (SEQ ID NO:1072) |
| 100_HySe29_Schwarzengrund | |
| 103_HySe32_Schwarzengrund | |
| 106_HySe35_Schwarzengrund | |

Fig. 44

| | ppic |
|---|---|
| 01_NBRC13245T_Typhimurium | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:584) |
| 02_GTC00131_Enteritidis | |
| 03_GTC09491_Enteritidis | |
| 04_GTC03838_Enteritidis | |
| 05_GTC08914_Enteritidis | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:619) |
| 06_GTC09421_Enteritidis | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:629) |
| 07_GTC09489_Enteritidis | |
| 08_NBRC3163_Pullorum_Gallinarum | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:645) |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:710) |
| 18_NBRC15182_Minnesota | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:720) |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:765) |
| 25_NBRC105684_Choleraesuis | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:775) |
| 26_NBRC105726_Typhimurium | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:784) |
| 27_JCM3919_UN_O7 | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:836) |
| 34_ATCCBAA-1738_Thompson | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:847) |
| 35_ATCC9712_Saintpaul | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:857) |
| 36_jfrlSe1402-1_Infantis | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:868) |
| 38_jfrlSe1402-3_Brandenburg | |
| 39_jfrlSe1402-4_Infantis | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:885) |
| 40_jfrlSe1402-5_Brandenburg | |
| 41_jfrlSe1402-6_Rissen | |
| 42_jfrlSe1402-7_Orion | MAKMAAALHILVKEEKMALDLLEQIKNGGDFEKLAKKHSICPSGKKGGHLGEFRQGQMVPAFD KVVFSCPVLEPTGPLHTQFGYHIIKVLYRK (SEQ ID NO:909) |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:953) |
| 49_jfrlSe1402-14_Mbandaka | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:964) |
| 50_jfrlSe1402-15_Orion | MAKMAAALHILVKEEKMALDLLEQIKNGGDFEKLAKKHSICPSGKKGGHLGEFRQGQMVPAFD KVVFSCPVLEPTGPLHTQFGYHIIKVLYRK (SEQ ID NO:974) |
| 51_jfrlSe1409-1_Altona | MAKMAAALHILVKEEKLALDLLEQIKNGGDFEKLAKKHSICPSGKKGGHLGEFRQGQMVPAFDK VVFSCPVLEPTGPLHTQFGYHIIKVLYRK (SEQ ID NO:982) |

Fig. 45

| | L25 |
|---|---|
| 01_NBRC13245T_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:585) |
| 02_GTC00131_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:594) |
| 03_GTC09491_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:603) |
| 04_GTC03838_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:610) |
| 05_GTC08914_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:620) |
| 06_GTC09421_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA |
| 07_GTC09489_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:636) |
| 08_NBRC3163_Pullorum_Gallinarum | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:646) |
| 09_NBRC3313_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:653) |
| 10_NBRC12529_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:660) |
| 11_NBRC14193_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:667) |
| 12_NBRC14194_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:674) |
| 13_NBRC14209_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:681) |
| 14_NBRC14210_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:688) |
| 15_NBRC14211_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:694) |
| 16_NBRC14212_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:701) |
| 17_NBRC15181_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:711) |
| 18_NBRC15182_Minnesota | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:721) |
| 19_NBRC15183_Minnesota | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:728) |
| 20_NBRC15184_Minnesota | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:735) |
| 21_NBRC15185_Minnesota | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:742) |
| 22_NBRC15186_Minnesota | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:749) |
| 23_NBRC15187_Minnesota | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:756) |
| 24_NBRC100797_Abony | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:766) |
| 25_NBRC105684_Choleraesuis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:776) |
| 26_NBRC105726_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:785) |
| 27_JCM3919_UN_O7_ | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:792) |
| 28_NBRC15335_Minnesota | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:799) |
| 29_GTC09490_Enteritidis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:806) |
| 30_GTC09492_Braenderup | MFTINAEVRKEQGKGASRRLRAANKFPAIIYGGSEAPVAIELDHDQVMNMQAKAEFYSEVLTLVVDGKEVKVKAQAVQRHAYKPKLTHIDFVRA (SEQ ID NO:813) |
| 31_GTC09493_Pakistan | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:817) |
| 32_GTC09549_Typhimurium | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:827) |
| 33_ATCCBAA-1675_Infantis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:837) |
| 34_ATCCBAA-1738_Thompson | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:848) |
| 35_ATCC9712_Saintpaul | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:858) |
| 36_jfrlSe1402-1_Infantis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:869) |
| 38_jfrlSe1402-3_Brandenburg | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:876) |
| 39_jfrlSe1402-4_Infantis | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:886) |
| 40_jfrlSe1402-5_Brandenburg | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:893) |
| 41_jfrlSe1402-6_Rissen | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:900) |
| 42_jfrlSe1402-7_Orion | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:910) |
| 43_jfrlSe1402-8_Rissen | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:917) |
| 44_jfrlSe1402-9_Rissen | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:924) |
| 45_jfrlSe1402-10_Rissen | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:931) |
| 46_jfrlSe1402-11_Rissen | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:938) |
| 47_jfrlSe1402-12_Rissen | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:945) |
| 48_jfrlSe1402-13_Mbandaka | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:954) |
| 49_jfrlSe1402-14_Mbandaka | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:965) |
| 50_jfrlSe1402-15_Orion | MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA (SEQ ID NO:975) |
| 51_jfrlSe1409-1_Altona | |
| 52_jfrlSe1409-2_Istanbul | |
| 53_jfrlSe1409-3_Senftenberg | |
| 54_jfrlSe1409-4_UN_O13_ | |
| 55_jfrlSe1409-5_UN_O1,3,19_ | |
| 56_jfrlSe1409-6_Montevideo | |
| 57_jfrlSe1409-7_UN_O1,3,19_ | |
| 58_jfrlSe1409-8_UN_O18_ | |
| 61_jfrlSe1409-11_UN_O1,3,19_ | |
| 67_jfrlSe1409-17_Rissen | |
| 71_jfrlSe1409-21_Amsterdam | MFTINAEVRKEQGKGASRRLRAANKFPAIIYGGSEAPVAIELDHDQVMNMQAKAEFYSEVLTLVVDGKEVKVKAQAVQRHAYKPKLTHIDFVRA (SEQ ID NO:1064) |
| 80_HySe09_Enteritidis | MFTINAEVRKEQGKGASRRLRAANKFPAIIYGGSEAPVAIELDHDQVMNMQAKAEFYSEVLTLVVDGKEVKVKAQAVQRHAYKPKLTHIDFVRA (SEQ ID NO:1074) |
| 100_HySe29_Schwarzengrund | |
| 103_HySe32_Schwarzengrund | |
| 106_HySe35_Schwarzengrund | |

Fig. 46

| | YaiA |
|---|---|
| 01_NBRC13245T_Typhimurium | MPTRPPYPREAYIVTIEKGTPGQTVTWYQLRADHPKPDSLISEHPTAEEAMDAKNRYEDPDKS (SEQ ID NO:586) |
| 02_GTC00131_Enteritidis | MPTRPPYPREAYIVTIEKGTPGQTVTWYQLRADHPKPDSLISEHPTAEEAMDAKKRYEDPDKS (SEQ ID NO:595) |
| 03_GTC09491_Enteritidis | |
| 04_GTC03838_Enteritidis | |
| 05_GTC08914_Enteritidis | |
| 06_GTC09421_Enteritidis | |
| 07_GTC09489_Enteritidis | |
| 08_NBRC3163_Pullorum_Gallinarum | |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | |
| 18_NBRC15182_Minnesota | |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | |
| 25_NBRC105684_Choleraesuis | |
| 26_NBRC105726_Typhimurium | |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | |
| 34_ATCCBAA-1738_Thompson | |
| 35_ATCC9712_Saintpaul | MPTRPPYPREAYIVTIEKGTPGQTVTWYQLRADHPKPDSLISEHPTAEEAMDAKKRYEDPDKS (SEQ ID NO:859) |
| 36_jfrlSe1402-1_Infantis | |
| 38_jfrlSe1402-3_Brandenburg | |
| 39_jfrlSe1402-4_Infantis | |
| 40_jfrlSe1402-5_Brandenburg | |
| 41_jfrlSe1402-6_Rissen | |
| 42_jfrlSe1402-7_Orion | |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | |
| 49_jfrlSe1402-14_Mbandaka | |
| 50_jfrlSe1402-15_Orion | |
| 51_jfrlSe1409-1_Altona | |
| 52_jfrlSe1409-2_Istanbul | |
| 53_jfrlSe1409-3_Senftenberg | |
| 54_jfrlSe1409-4_UN_O13_ | |
| 55_jfrlSe1409-5_UN_O1,3,19_ | |
| 56_jfrlSe1409-6_Montevideo | |
| 57_jfrlSe1409-7_UN_O1,3,19_ | |
| 58_jfrlSe1409-8_UN_O18_ | |
| 61_jfrlSe1409-11_UN_O1,3,19_ | |
| 67_jfrlSe1409-17_Rissen | |
| 71_jfrlSe1409-21_Amsterdam | |
| 80_HySe09_Enteritidis | |
| 100_HySe29_Schwarzengrund | |
| 103_HySe32_Schwarzengrund | |
| 106_HySe35_Schwarzengrund | |

Fig. 47

| | YciF |
|---|---|
| 01_NBRC13245T_Typhimurium | MNIKTVEDLFIHLLSDTYSAEKQLTKALPKLARATSNEKLSQAFQSHLEETQGQIERIDQIVESESGIKLKRMKCVAMEGLIEEANEVIESTEKNEVRDAALIAAAQKVEHYEIASYGTLATLAEQLGYSKALKLLKETLDEEKQTDLKLTDLAVSNVNKSAERKSK (SEQ ID NO:587) |
| 02_GTC00131_Enteritidis | MNIKTVEDLFIHLLSDTYSAEKQLTKALSKLARATSNEKLSQAFQSHLEETQGQIERIDQIVESESGIKLKRMKCVAMEGLIEEANEVIESTEKNEVRDAALIAAAQKVEHYEIASYGTLATLAEQLGYSKALKLLKETLDEEKQTDLKLTDLAVSNVNKSAERKSK (SEQ ID NO:596) |
| 03_GTC09491_Enteritidis | |
| 04_GTC03838_Enteritidis | |
| 05_GTC08914_Enteritidis | |
| 06_GTC09421_Enteritidis | |
| 07_GTC09489_Enteritidis | |
| 08_NBRC3163_Pullorum_Gallinarum | |
| 09_NBRC3313_Enteritidis | |
| 10_NBRC12529_Typhimurium | |
| 11_NBRC14193_Typhimurium | |
| 12_NBRC14194_Typhimurium | |
| 13_NBRC14209_Typhimurium | |
| 14_NBRC14210_Typhimurium | |
| 15_NBRC14211_Typhimurium | |
| 16_NBRC14212_Typhimurium | |
| 17_NBRC15181_Typhimurium | |
| 18_NBRC15182_Minnesota | |
| 19_NBRC15183_Minnesota | |
| 20_NBRC15184_Minnesota | |
| 21_NBRC15185_Minnesota | |
| 22_NBRC15186_Minnesota | |
| 23_NBRC15187_Minnesota | |
| 24_NBRC100797_Abony | |
| 25_NBRC105684_Choleraesuis | |
| 26_NBRC105726_Typhimurium | |
| 27_JCM3919_UN_O7_ | |
| 28_NBRC15335_Minnesota | |
| 29_GTC09490_Enteritidis | |
| 30_GTC09492_Braenderup | |
| 31_GTC09493_Pakistan | |
| 32_GTC09549_Typhimurium | |
| 33_ATCCBAA-1675_Infantis | MNIKTVEDLFIHLLSDTYSAEKQLTKALSKLARATSNEKLSQAFQSHLEETQGQIERIDQIVESESGIKLKRMKCVAMEGLIEEANEVIESTEKNEVRDAALIAAAQKVEHYEIASYGTLATLAEQLGYSKALKLLKETLDEEKQTDLKLTDLAVSNVNKSAERKSK (SEQ ID NO:838) |
| 34_ATCCBAA-1738_Thompson | |
| 35_ATCC9712_Saintpaul | |
| 36_jfrlSe1402-1_Infantis | |
| 38_jfrlSe1402-3_Brandenburg | |
| 39_jfrlSe1402-4_Infantis | |
| 40_jfrlSe1402-5_Brandenburg | |
| 41_jfrlSe1402-6_Rissen | |
| 42_jfrlSe1402-7_Orion | |
| 43_jfrlSe1402-8_Rissen | |
| 44_jfrlSe1402-9_Rissen | |
| 45_jfrlSe1402-10_Rissen | |
| 46_jfrlSe1402-11_Rissen | |
| 47_jfrlSe1402-12_Rissen | |
| 48_jfrlSe1402-13_Mbandaka | MNIKTVEDLFIHLLSDTYSAEKQLTKALPKLARATSNEKLSQAFQSHLEETQGQIERIDQIVESESGIKLKRMKCVAMEGLIEEANEVIESTEKNEVRDAALIAAAQKVEHYEIASYGTLATLAEQLGYSKALKLLKETLDEEKQTDLKLTDLAVSNVNKSAERKSK (SEQ ID NO:955) |
| 49_jfrlSe1402-14_Mbandaka | |
| 50_jfrlSe1402-15_Orion | |
| 51_jfrlSe1409-1_Altona | |
| 52_jfrlSe1409-2_Istanbul | |
| 53_jfrlSe1409-3_Senftenberg | MNIKTVEDLFIHLLSDTYSAEKQLTKALPKLARATSNEKLSQAFQSHLEETQGQIERIDQIVESESGIKLKRIKCVAMEGLIEEANEVIESTEKNEVRDAALIAAAQKVEHYEIASYGTLATLAEQLGYGKALKLLKETLDEEKQTDLKLTDLAVSNVNKSAERKSK (SEQ ID NO:995) |
| 54_jfrlSe1409-4_UN_O13_ | |
| 55_jfrlSe1409-5_UN_O1,3,19_ | |
| 56_jfrlSe1409-6_Montevideo | |
| 57_jfrlSe1409-7_UN_O1,3,19_ | |
| 58_jfrlSe1409-8_UN_O18_ | |
| 61_jfrlSe1409-11_UN_O1,3,19_ | |
| 67_jfrlSe1409-17_Rissen | |
| 71_jfrlSe1409-21_Amsterdam | |
| 80_HySe09_Enteritidis | |
| 100_HySe29_Schwarzengrund | |
| 103_HySe32_Schwarzengrund | |
| 106_HySe35_Schwarzengrund | |

MICROORGANISM IDENTIFICATION METHOD

CROSS-REFERENCE TO RELATED APPLICATIONS

This application is a Rule 53(b) Continuation application of U.S. application Ser. No. 16/089,836 filed Sep. 28, 2018, which is a National Stage of International Application No. PCT/JP2016/060865 filed Mar. 31, 2016, the respective disclosures of all of the above of which are incorporated herein by reference in their entirety.

STATEMENT OF JOINT RESEARCH AGREEMENT

Pursuant to 35 U.S.C. § 102 (c), the undersigned states on behalf of SHIMADZU CORPORATION AND MEIJO UNIVERSITY that the subject matter of U.S. Pat. No. 11,774,448 and the claimed invention were made by or on the behalf of parties to a joint research agreement within the meaning of 35 U.S.C. §§ 100(h) and 102(c) and 37 C.F.R. § 1.9(e), that the joint research agreement was in effect on or before the effective filing date of the claimed invention, and that the claimed invention was made as a result of activities undertaken within the scope of the joint research agreement.

INCORPORATION

The content of the electronically submitted sequence listing, file name: Q289660_sequence listing as filed; size 1,232,443 bytes; and date of creation: Nov. 1, 2023, filed herewith, is incorporated herein by reference in its entirety.

TECHNICAL FIELD

The present invention relates to a microorganism identification method using mass spectrometry.

BACKGROUND ART

*Salmonella* belongs to the family of enterobacteriaceae of gram-negative facultative anaerobic bacilli, and three species of *Salmonella enterica*, *Salmonella bongori* and *Salmonella subterranea* belong to the genus *Salmonella*. Further, *Salmonella enterica* is classified into six subspecies (*Salmonella* (sometimes abbreviated as "S.") *enterica* subsp. *enterica*, *S. enterica* subsp. *salamae*, *S. enterica* subsp. *arizonae*, *S. enterica* subsp. *diarizonae*, *S. enterica* subsp. *houtenae*, *S. enterica* subsp. *indica*).

There are about 2,500 serovars in the genus *Salmonella*, which are decided by the Kauffmann-White classification based on the difference in combination of a cell wall lipopolysaccharide O antigen, and a flagellar protein H antigen. Pathogenic *Salmonella* such as *Salmonella* causing food poisoning belongs mostly to *S. enterica* subsp. *enterica*. This subspecies is also classified into about 1,500 types of serovars (Non Patent Literature 1). Currently, in order to decide the serovar, an agglutination test with antisera is used. It is an O type test by slide agglutination and an H type test by test tube agglutination, and the H type test increases mobility and performs phase induction for first phase and second phase decision, thus requires time and proficient skills for serovar decision.

Some serovars have determined pathogenic hosts. For example, *typhi*, *choleraesuis*, Dublin and *gallinarum* cause systemic infection specifically in humans, pigs, cattle, and chickens. However, many other serovars infect multiple hosts like humans, domestic animals, pets and wild animals and become pathogens of nontyphoidal acute gastroenteritis (food poisoning). Infection routes of nontyphoidal *Salmonella* range widely such as environments such as rivers, wild animals, pets, and foods (including secondary pollution as well as primary pollution such as through rodents and insects). Serovar decision is important for infection prevention and epidemiological analysis and has been used for more than 80 years (Non Patent Literature 2).

Highly detected serovars of nontyphoidal *Salmonella* infections in recent years are Enteritidis, Thompson, Infantis, Typhimurium, Saintpaul, Braenderup, Schwarzengrund, Litchfield, and Montevideo (IASR HP (Reference Document 1)). In the Act on Domestic Animal Infectious Diseases Control in Japan, when livestock is infected with Dublin, Enteritidis, Typhimurium or *choleraesuis*, notification to the Ministry of Agriculture, Forestry and Fisheries is mandatory.

As methods for detecting *Salmonella* and deciding serovars, multiplex PCR (Non Patent Literatures 3 and 4), pulsed field gel electrophoresis (Non Patent Literature 5), multilocus sequence typing method (Non Patent Literature 6) and the like have been reported so far. However, with multiplex PCR, there are problems that only a few serovars are decided, or only a part of the O antigen and H antigen is decided, and the other methods require a complicated operation and take time.

On the other hand, in recent years, the microorganism identification technique by matrix-assisted laser desorption/ionization time-of-flight mass-spectrometry (MALDI-TOF MS) has spread rapidly in clinical and food fields. This method is a method of identifying microorganisms based on a mass spectral pattern obtained using a very small amount of microorganism sample, which can obtain an analysis result in a short time and also easily perform continuous analysis of multiple specimens. Therefore, easy and rapid microorganism identification is possible. So far, attempts have been made to identify *Salmonella* using MALDI-TOF MS by multiple research groups (Non Patent Literatures 7, 8, 9, 10)

Non Patent Literature 10 distinguishes subspecies of *Salmonella enterica* subsp. *enterica* and five major serovars by selecting a biomarker and preparing a decision tree. While the research by Dieckmann et al. scrutinizes protein peaks very minutely, there are strains in which biomarker peak is present or absent, and it takes time to confirm the peak.

CITATION LIST

Patent Literature

Patent Literature 1: JP 2006-191922 A
Patent Literature 2: JP 2013-085517 A

Non Patent Literature

Non Patent Literature 1: ANTIGENIC FORMULAE OF THE SALMONELLA SEROVARS 2007 9th edition WHO Collaborating Center for Reference and Research on Salmonella Patrick A. D. Grimont, François-Xavier Weill Institut Pasteur, 28 rue du Dr. Roux, 75724 Paris Cedex 15, France
Non Patent Literature 2: Winfield&Groisman, 2003, Fukuoka Institute of Health and Environmental Sciences Non Patent Literature 3: M Akiba Et. al., Microbiological Methods, 2011, 85, 9-15

Non Patent Literature 4: Y Hong et al., BMC microbiology 2008, 8: 178

Non Patent Literature 5: F Tenover, et al. Journal of clinical microbiology 33.9 (1995): 2233.

Non Patent Literature 6: M Achtman, et al. PLoS Pathog 8.6 (2012): e1002776.

Non Patent Literature 7: Seng, Piseth, et al. Future microbiology 5.11 (2010): 1733-1754.

Non Patent Literature 8: M Kuhns et al. PLoS One 7.6 (2012): e40004.

Non Patent Literature 9: R Dieckmann et al. AEM, 74.24 (2008): 7767-7778.

Non Patent Literature 10: R Dieckmann, et al. (2011): AEM-02418.

Non Patent Literature 11: T, Ojima-Kato, et al. PLOS one 2014: e113458.

SUMMARY OF INVENTION

Technical Problem

On the other hand, Patent Literature 1 shows that a method (S10-GERMS method) of attributing the type of protein to be the origin of the peak by associating the mass-to-charge ratio of the peak obtained by mass spectrometry with a calculated mass estimated from the amino acid sequence obtained by translating the base sequence information of the ribosomal protein gene, utilizing the fact that about half of the peaks obtained by subjecting microbial cells to mass spectrometry is derived from ribosomal proteins, is useful (Patent Literature 1). According to this method, it is possible to perform highly reliable microorganism identification based on a theoretical basis using mass spectrometry and software attached thereto (Patent Literature 2).

An object to be solved by the present invention is to provide a highly reliable biomarker based on genetic information that can rapidly and easily identify the serovar of *Salmonella enterica* subsp. *enterica*.

Solution to Problem

As a result of extensive studies, the present inventors have found that two types of ribosomal proteins S8 and Peptidylpropyl isomerase are useful as marker proteins used for identifying which species of serovar of *Salmonella* genus bacteria is contained in a sample by mass spectrometry, and it is possible to identify the serovar of *Salmonella* genus bacteria reproducibly and quickly by using at least one of these ribosomal proteins, and have reached the present invention.

More specifically, a microorganism identification method according to the present invention, which has been made to solve the above problems, includes
a) a step of subjecting a sample containing microorganisms to mass spectrometry to obtain a mass spectrum,
b) a step of reading a mass-to-charge ratio m/z of a peak derived from a marker protein from the mass spectrum, and
c) an identification step of identifying which bacteria of serovar of *Salmonella* genus bacteria the microorganisms contained in the sample contain, based on the mass-to-charge ratio m/z, in which at least one of two types of ribosomal proteins S8 and Peptidylpropyl isomerase is used as the marker protein.

In the above microorganism identification method, it is preferable that the serovars of *Salmonella* genus bacteria are classified using cluster analysis using as an index the mass-to-charge ratio m/z derived from at least 12 types of ribosomal proteins S8, L15, L17, L21, L25, S7, SODa, Peptidylpropyl isomerase, gns, YibT, YaiA and YciF as the marker protein.

In this case, it is preferable to further include a step of generating a dendrogram representing an identification result by the cluster analysis.

In addition, in the above microorganism identification method, when the serovar of *Salmonella* genus bacteria is Orion, at least Peptidylpropyl isomerase is preferably contained as the marker protein.

Moreover, when the serovar of *Salmonella* genus bacteria is Rissen, at least S8 is preferably contained as the marker protein.

Also, when the serovar of *Salmonella* genus bacteria is Saintpaul, at least L21, S7, YaiA and YciF are preferably contained as the marker protein.

Further, when the serovar of *Salmonella* genus bacteria is Braenderup, at least the group consisting of SOD, or gns and L25 is preferably contained as the marker protein.

Furthermore, when the serovar of *Salmonella* genus bacteria is Montevideo or Schwarzengrund, at least one of SOD and L21, and S7 are preferably contained as the marker protein.

Also, when the serovar of *Salmonella* genus bacteria is Enteritidis, at least SOD, L17 and S7 are preferably contained as the marker protein.

Further, when the serovar of *Salmonella* genus bacteria is *infantis*, at least SOD, L21, S7, YibT and YciF are preferably contained as the marker protein.

Advantageous Effects of Invention

According to the present invention, since a ribosomal protein showing a mutation peculiar to the serovar of *Salmonella* genus bacteria is used as the marker protein, the serovar of *Salmonella* genus bacteria can be reproducibly and quickly identified.

Also, by using a ribosomal protein showing a mutation peculiar to the serovar of *Salmonella* genus bacteria as the marker protein and performing a cluster analysis using the mass-to-charge ratio m/z of the peak derived from the marker protein on the mass spectrum as an index, the serovars of *Salmonella* genus bacteria contained in a plurality of samples can be collectively identified.

BRIEF DESCRIPTION OF DRAWINGS

FIG. 1 is a configuration diagram showing a main part of a microorganism identification system used for a microorganism identification method according to the present invention.

FIG. 2 is a flowchart showing an example of a procedure of a microorganism identification method according to the present invention.

FIG. 3 shows a list of species name, subspecies name and serovar of *Salmonella* genus bacteria used in examples.

FIG. 4 shows relationships between a combination of an agglutinated immune serum and a serovar.

FIG. 5 shows a list of primers used in examples.

FIG. 6 shows a mass of each amino acid.

Figures 7A, 7B:
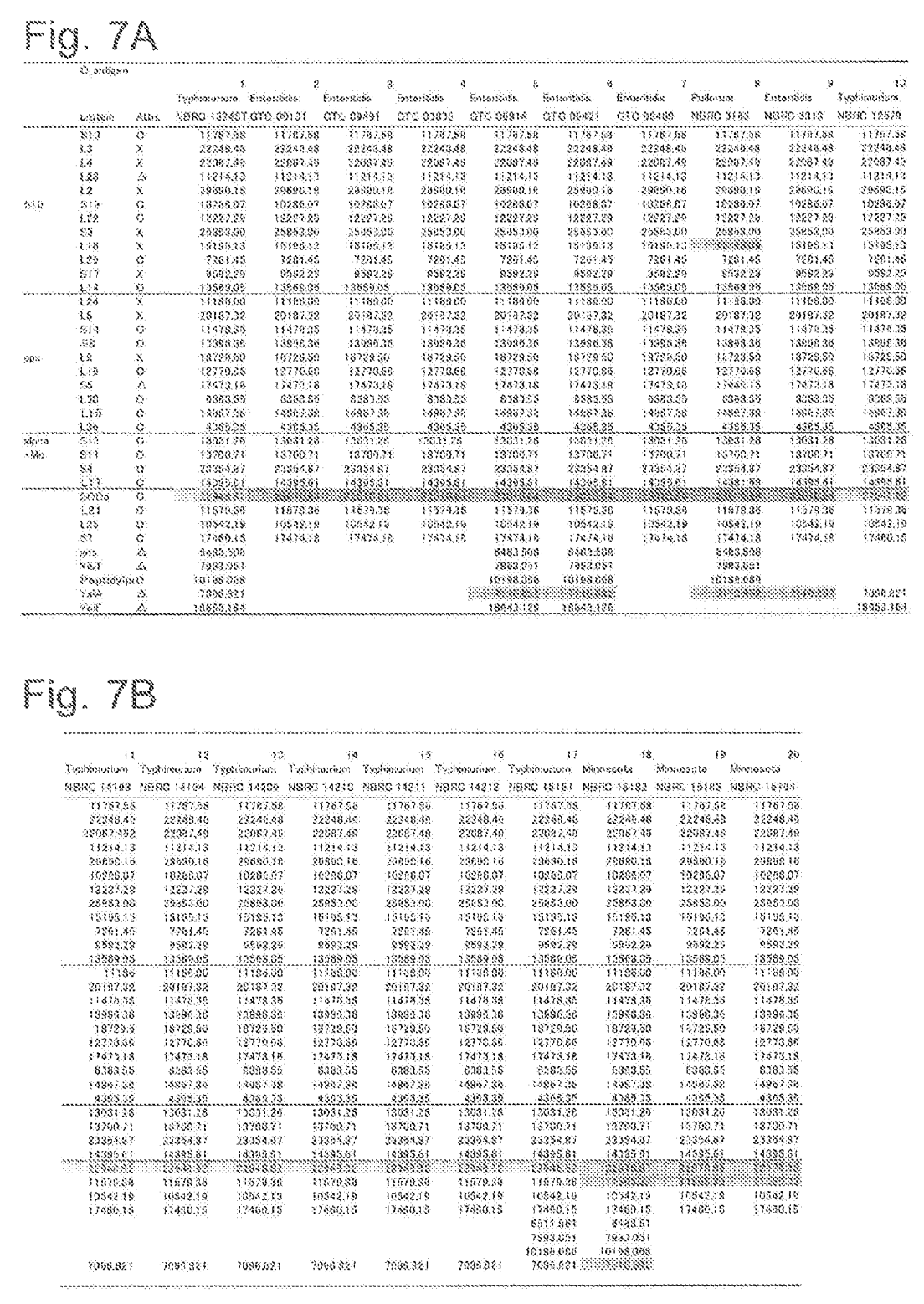
Figures 7C, 7D:
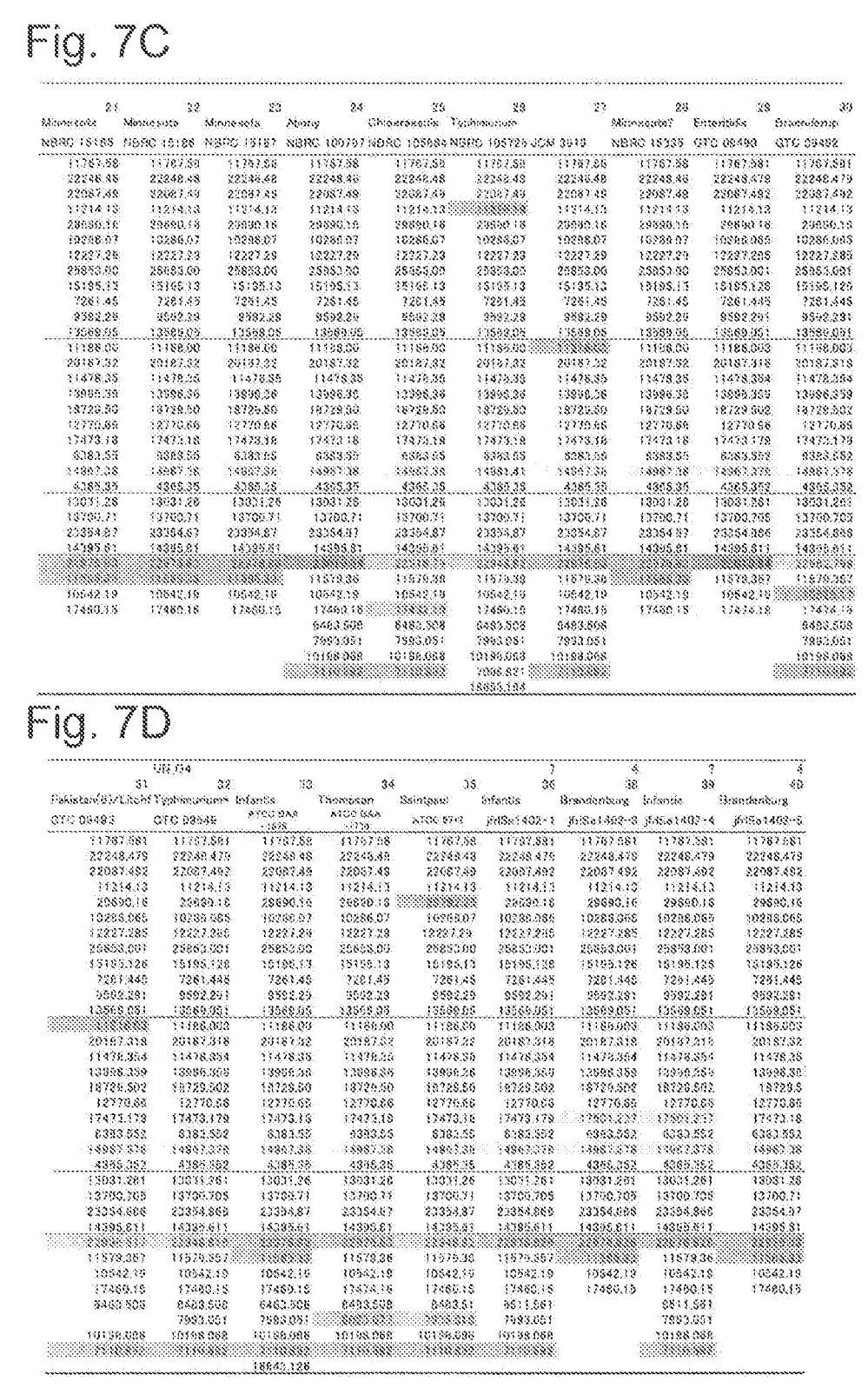
Figures 7E, 7F:
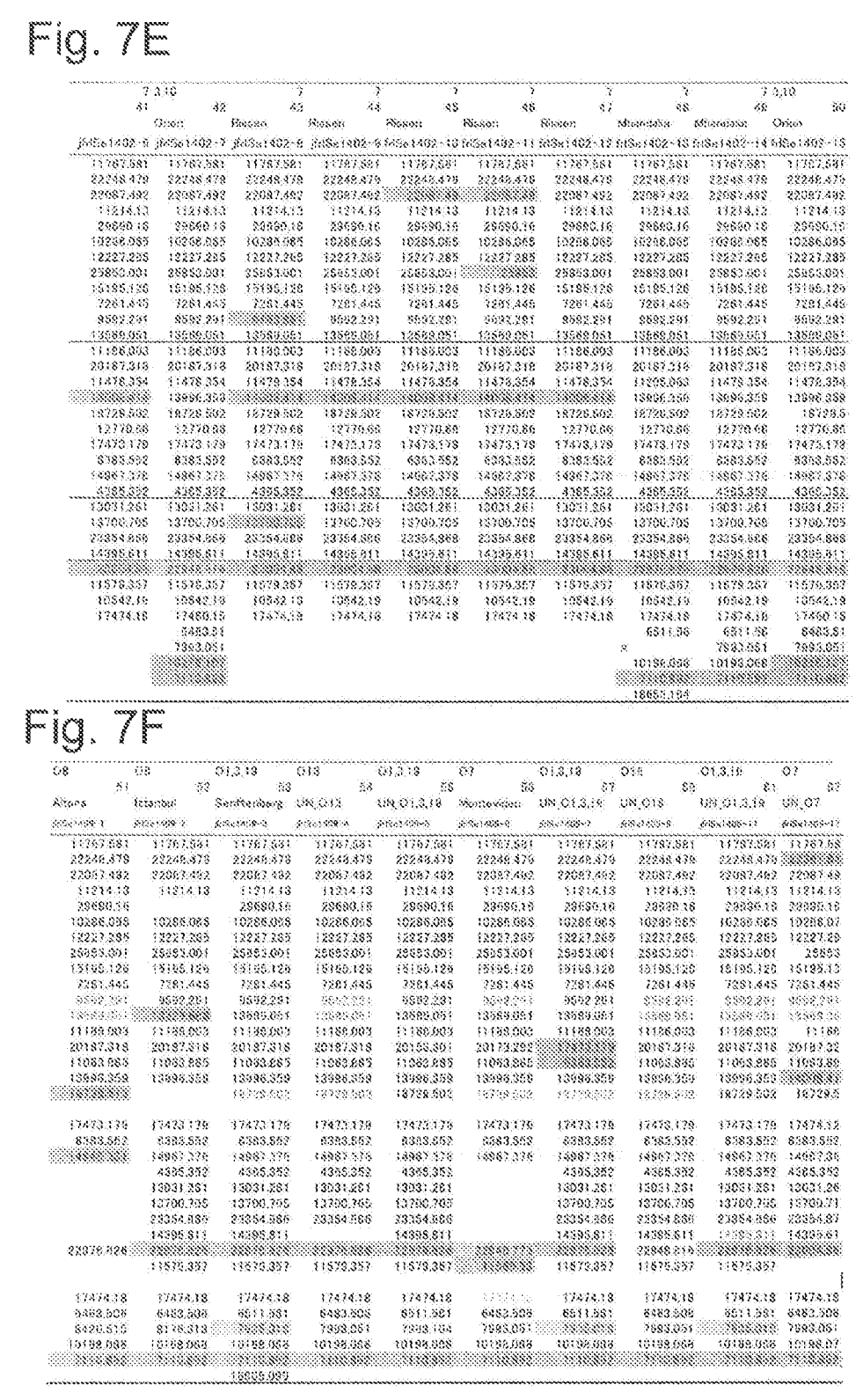
Figure 7G:
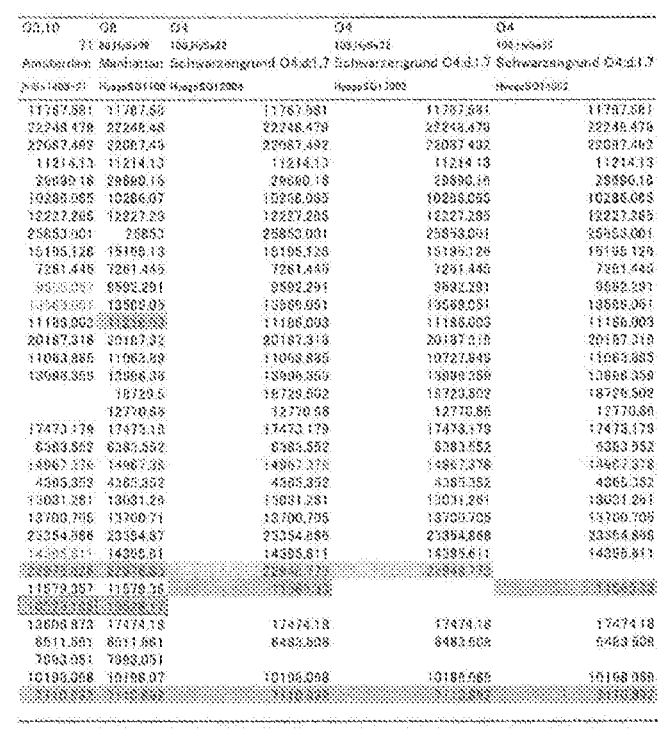

FIG. 7A shows a list of theoretical mass values of each ribosomal protein of *Salmonella* genus bacteria used in examples and measured values by MALDI-TOF MS (part 1).

FIG. 7B shows a list of theoretical mass values of each ribosomal protein of *Salmonella* genus bacteria used in examples and measured values by MALDI-TOF MS (part 2).

FIG. 7C shows a list of theoretical mass values of each ribosomal protein of *Salmonella* genus bacteria used in examples and measured values by MALDI-TOF MS (part 3).

FIG. 7D shows a list of theoretical mass values of each ribosomal protein of *Salmonella* genus bacteria used in examples and measured values by MALDI-TOF MS (part 4).

FIG. 7E shows a list of theoretical mass values of each ribosomal protein of *Salmonella* genus bacteria used in examples and measured values by MALDI-TOF MS (part 5).

FIG. 7F shows a list of theoretical mass values of each ribosomal protein of *Salmonella* genus bacteria used in examples and measured values by MALDI-TOF MS (part 6).

FIG. 7G shows a list of theoretical mass values of each ribosomal protein of *Salmonella* genus bacteria used in examples and measured values by MALDI-TOF MS (part 7).

Figure 8A:
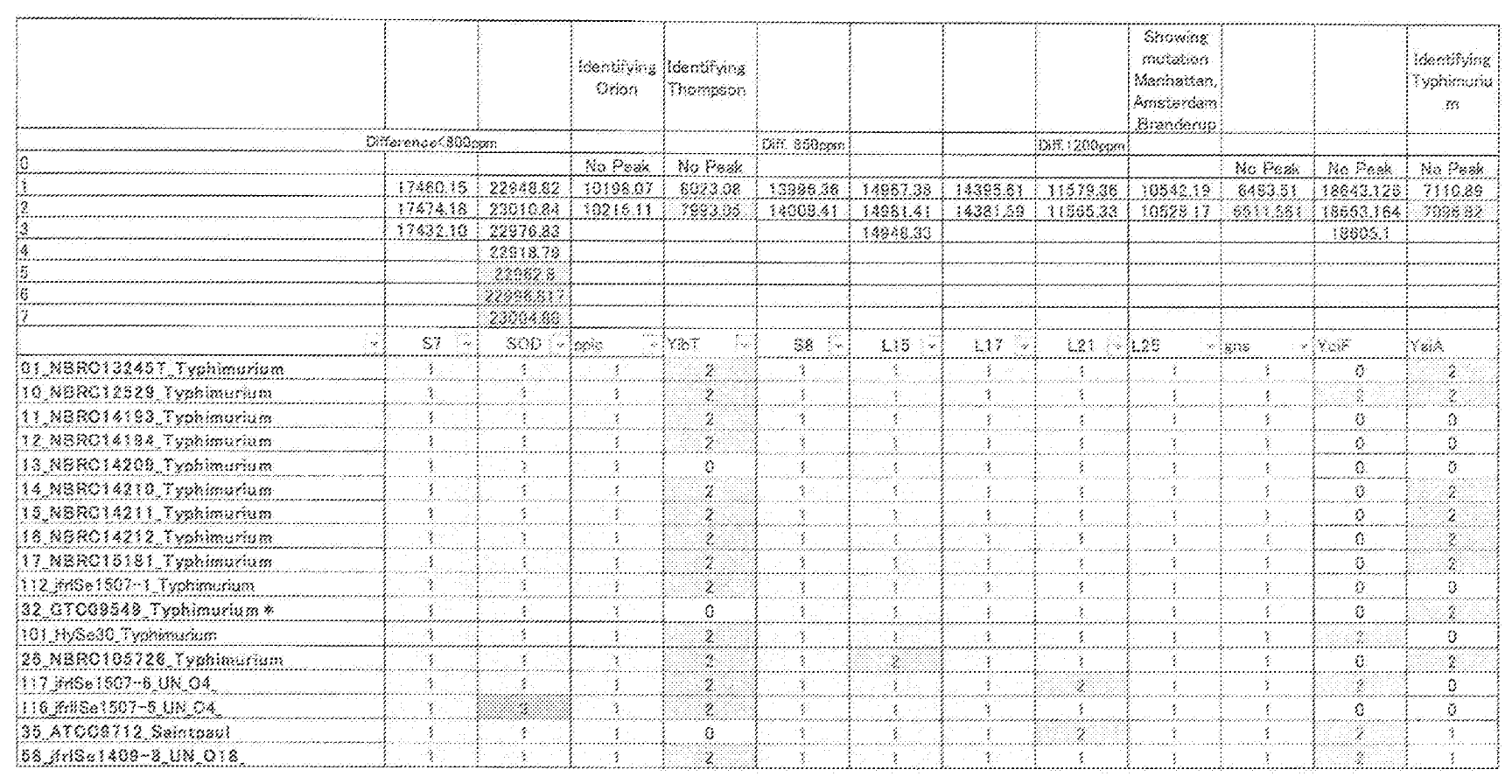
Figure 8B:
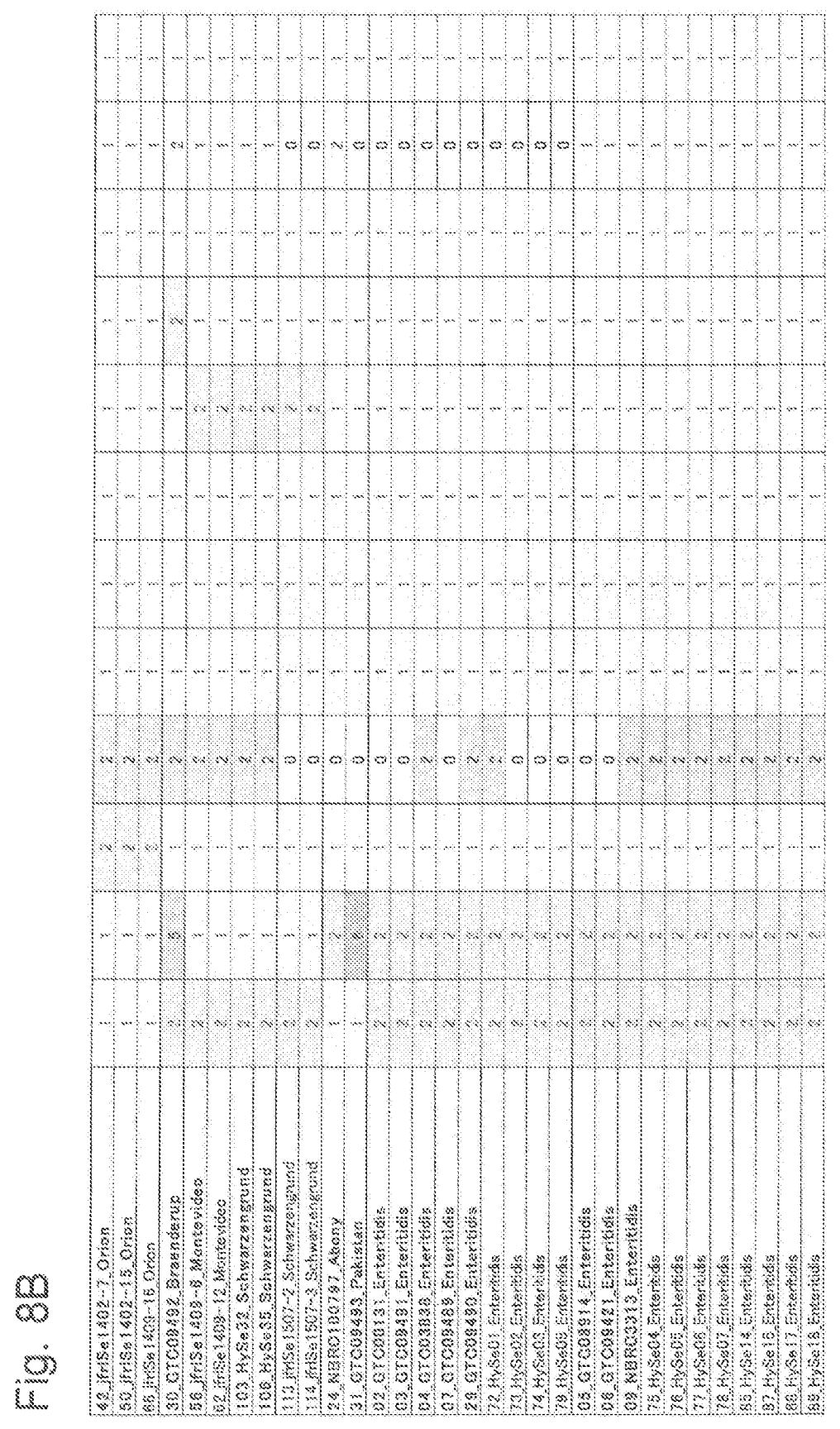
Figure 8C:
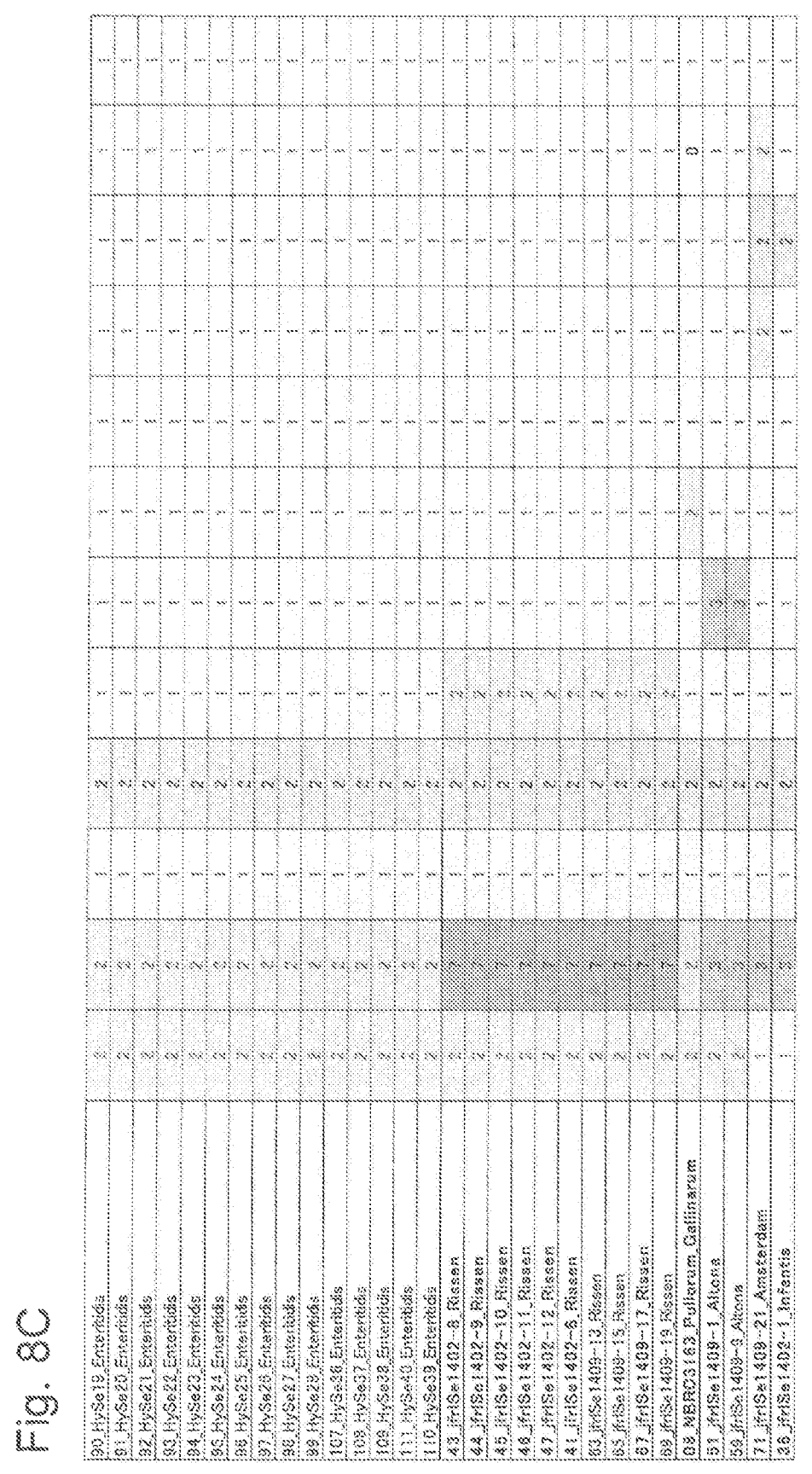
Figure 8D:
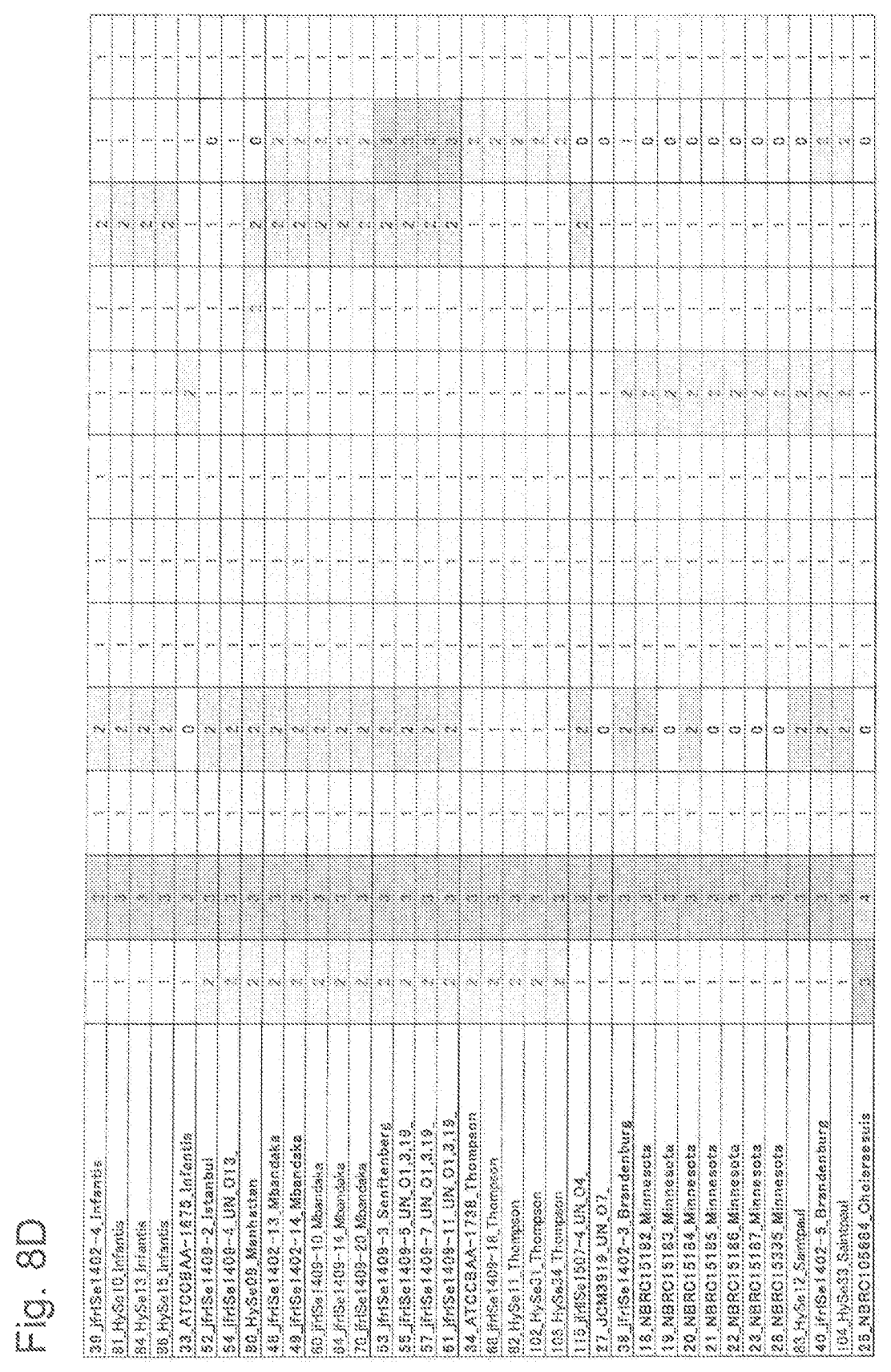

FIG. 8A is attribution results based on measured values of 12 types of ribosomal proteins (part 1).

FIG. 8B is attribution results based on measured values of 12 types of ribosomal proteins (part 2).

FIG. 8C is attribution results based on measured values of 12 types of ribosomal proteins (part 3).

FIG. 8D is attribution results based on measured values of 12 types of ribosomal proteins (part 4).

FIG. 10A is identification results by SARAMIS (part 1).

FIG. 10B is identification results by SARAMIS (part 2).

FIG. 24A is DNA sequences of ribosomal protein S8 (part 1).

FIG. 24B is DNA sequences of ribosomal protein S8 (part 2).

FIG. 24C is DNA sequences of ribosomal protein S8 (part 3).

FIG. 24D is DNA sequences of ribosomal protein S8 (part 4).

FIG. 25A is DNA sequences of ribosomal protein L15 (part 1).

FIG. 25B is DNA sequences of ribosomal protein L15 (part 2).

FIG. 25C is DNA sequences of ribosomal protein L15 (part 3).

FIG. 25D is DNA sequences of ribosomal protein L15 (part 4).

FIG. 25E is DNA sequences of ribosomal protein L15 (part 5).

FIG. 26A is DNA sequences of ribosomal protein L17 (part 1).

FIG. 26B is DNA sequences of ribosomal protein L17 (part 2).

FIG. 26C is DNA sequences of ribosomal protein L17 (part 3).

FIG. 26D is DNA sequences of ribosomal protein L17 (part 4).

FIG. 26E is DNA sequences of ribosomal protein L17 (part 5).

FIG. 27A is DNA sequences of ribosomal protein sodA (part 1).

FIG. 27B is DNA sequences of ribosomal protein sodA (part 2).

FIG. 27C is DNA sequences of ribosomal protein sodA (part 3).

FIG. 27D is DNA sequences of ribosomal protein sodA (part 4).

FIG. 27E is DNA sequences of ribosomal protein sodA (part 5).

FIG. 27F is DNA sequences of ribosomal protein sodA (part 6).

FIG. 27G is DNA sequences of ribosomal protein sodA (part 7).

FIG. 28A is DNA sequences of ribosomal protein L21 (part 1).

FIG. 28B is DNA sequences of ribosomal protein L21 (part 2).

FIG. 28C is DNA sequences of ribosomal protein L21 (part 3).

FIG. 28D is DNA sequences of ribosomal protein L21 (part 4).

FIG. 29A is DNA sequences of ribosomal protein L25 (part 1).

FIG. 29B is DNA sequences of ribosomal protein L25 (part 2).

FIG. 29C is DNA sequences of ribosomal protein L25 (part 3).

FIG. 30A is DNA sequences of ribosomal protein S7 (part 1).

FIG. 30B is DNA sequences of ribosomal protein S7 (part 2).

FIG. 30C is DNA sequences of ribosomal protein S7 (part 3).

FIG. 30D is DNA sequences of ribosomal protein S7 (part 4).

FIG. 30E is DNA sequences of ribosomal protein S7 (part 5).

FIG. 31A is DNA sequences of ribosomal protein gns (part 1).

FIG. 31B is DNA sequences of ribosomal protein gns (part 2).

FIG. 32A is DNA sequences of ribosomal protein yibT (part 1).

FIG. 32B is DNA sequences of ribosomal protein yibT (part 2).

FIG. 33A is DNA sequences of ribosomal protein ppiC (part 1).

FIG. 33B is DNA sequences of ribosomal protein ppiC (part 2).

FIG. 34 is DNA sequences of ribosomal protein yaiA.

FIG. 35A is DNA sequences of ribosomal protein yciF (part 1).

FIG. 35B is DNA sequences of ribosomal protein yciF (part 2).

FIG. 36A is amino acid sequences of ribosomal protein SOD (part 1).

FIG. 36B is amino acid sequences of ribosomal protein SOD (part 2).

FIG. 36C is amino acid sequences of ribosomal protein SOD (part 3).

FIG. 37A is amino acid sequences of ribosomal protein L17 (part 1).

FIG. 37B is amino acid sequences of ribosomal protein L17 (part 2).

FIG. 38A is amino acid sequences of ribosomal protein L21 (part 1).

FIG. 38B is amino acid sequences of ribosomal protein L21 (part 2).

FIG. 39A is amino acid sequences of ribosomal protein S8 (part 1).

FIG. 39B is amino acid sequences of ribosomal protein S8 (part 2).

FIG. 40A is amino acid sequences of ribosomal protein L15 (part 1).

FIG. 40B is amino acid sequences of ribosomal protein L15 (part 2).

FIG. 41A is amino acid sequences of ribosomal protein S7 (part 1).

FIG. 41B is amino acid sequences of ribosomal protein S7 (part 2).

FIG. 42 is amino acid sequences of ribosomal protein gns.

FIG. 43 is amino acid sequences of the ribosomal protein YibT.

FIG. 44 is amino acid sequences of the ribosomal protein ppic.

FIG. 45 is amino acid sequences of ribosomal protein L25.

FIG. 46 is amino acid sequences of ribosomal protein YaiA.

FIG. 47 is amino acid sequences of ribosomal protein YciF.

DESCRIPTION OF EMBODIMENTS

Figure 9:
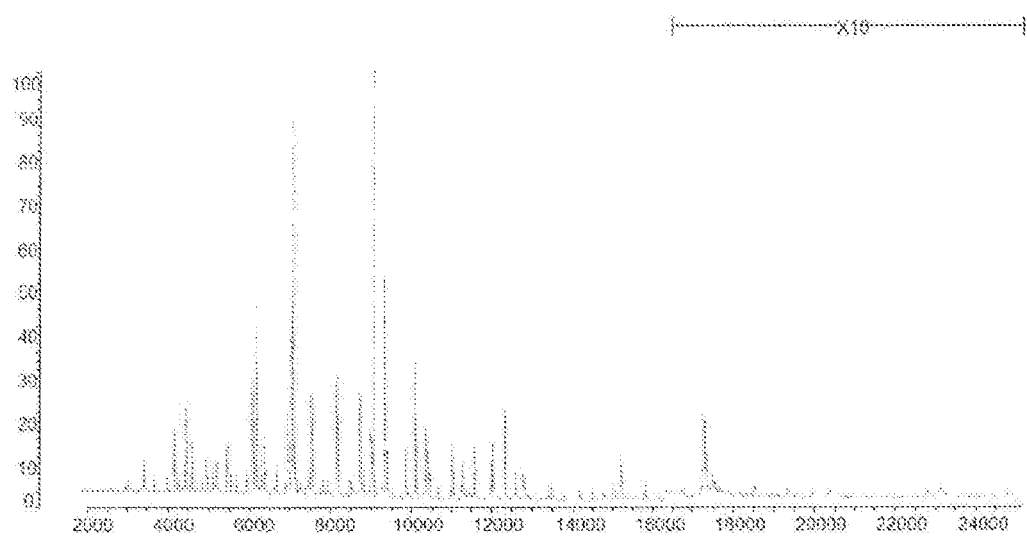
FIG. 9 is a chart obtained by MALDI-TOF MS measurement.
Figure 11:
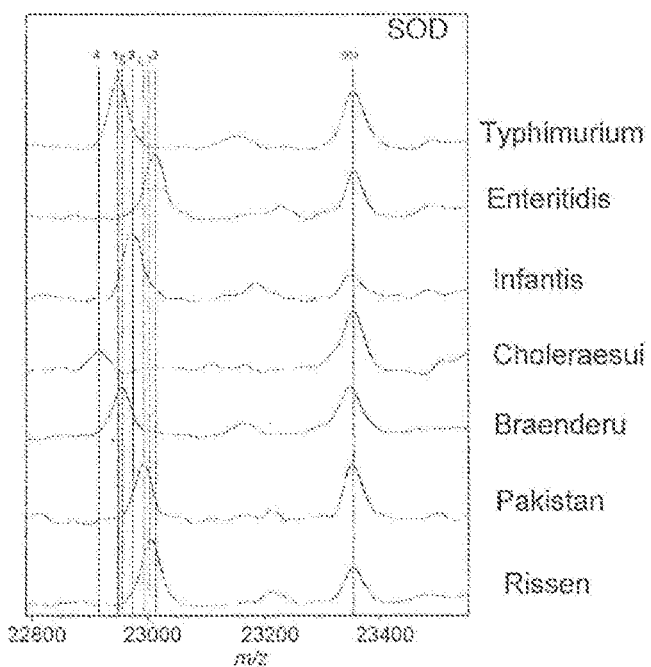
FIG. 11 is a peak chart of ribosomal protein SOD.
Figure 12:
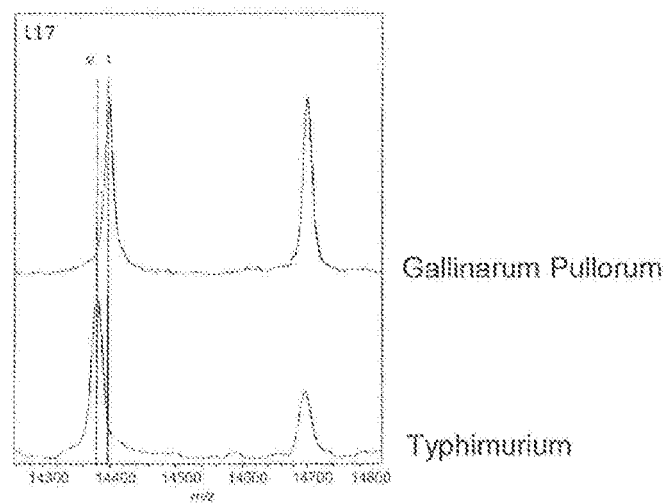
FIG. 12 is a peak chart of ribosomal protein L17.
Figure 13:
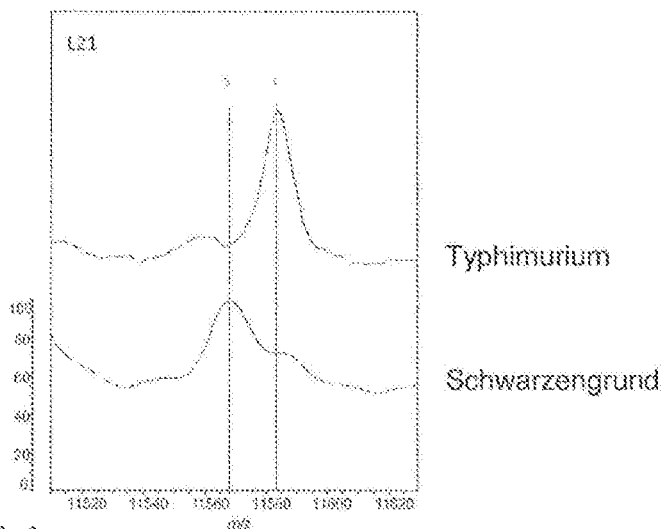
FIG. 13 is a peak chart of ribosomal protein L21.
Figure 14:
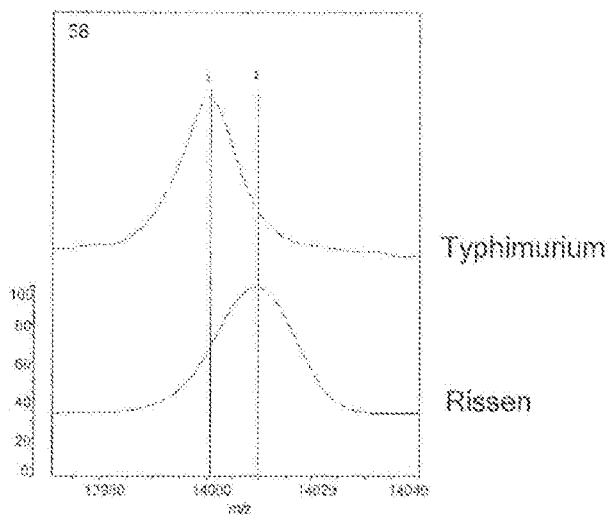
FIG. 14 is a peak chart of ribosomal protein S8.
Figure 15:
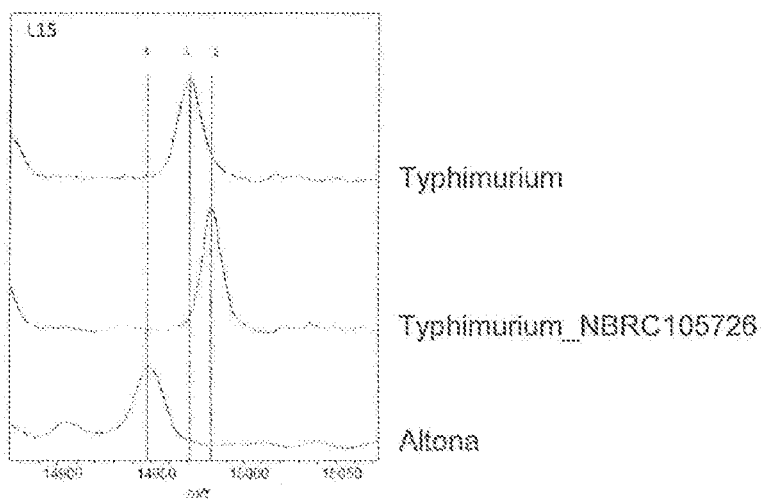
FIG. 15 is a peak chart of ribosomal protein L15.
Figure 16:
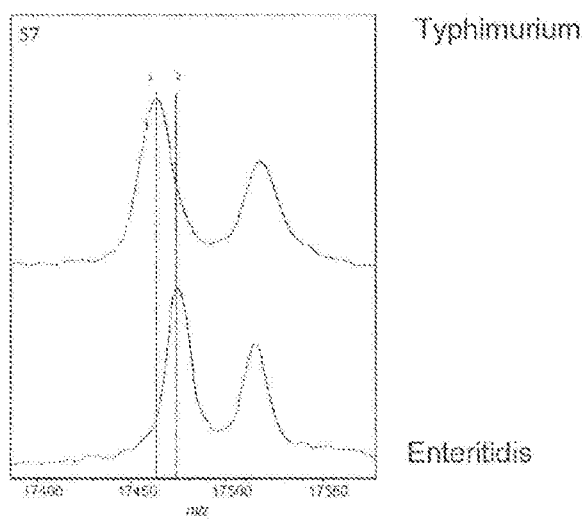
FIG. 16 is a peak chart of ribosomal protein S7.
Figure 17:
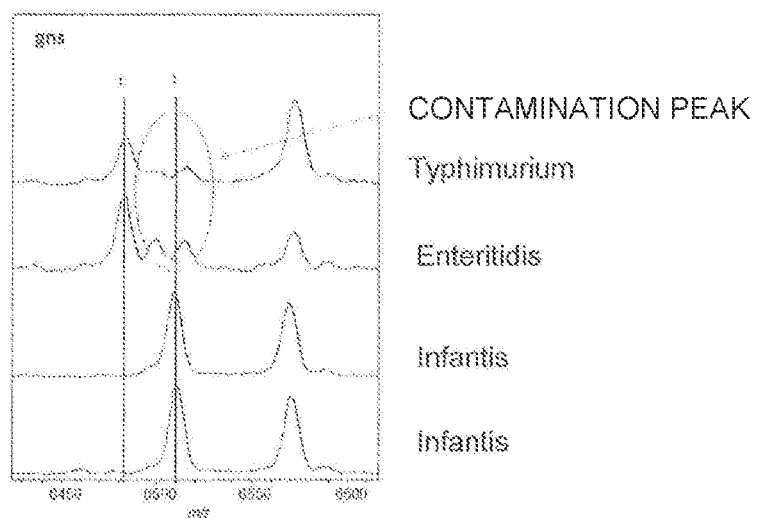
FIG. 17 is a peak chart of ribosomal protein gns.
Figure 18:
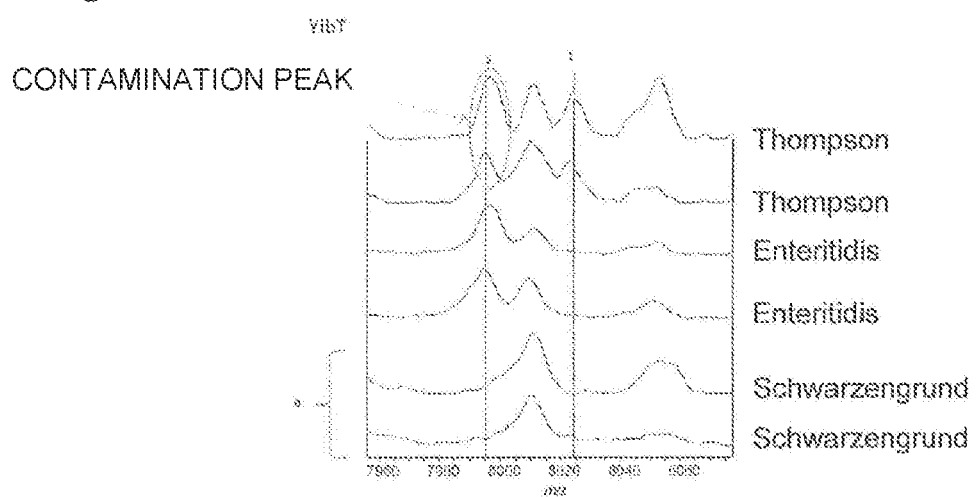
FIG. 18 is a peak chart of ribosomal protein YibT.
Figure 19:
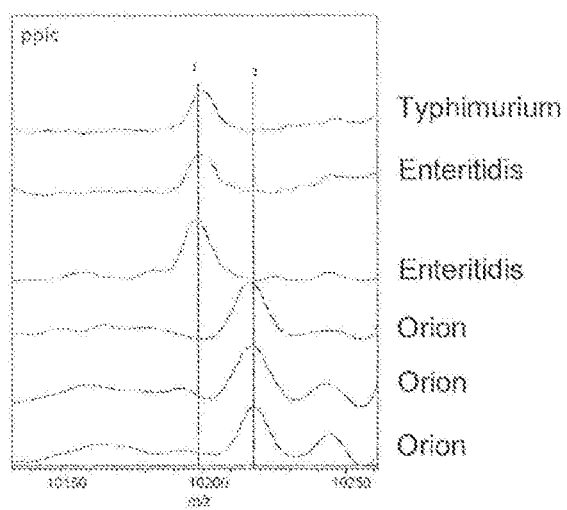
FIG. 19 is a peak chart of ribosomal protein ppic.
Figure 20:
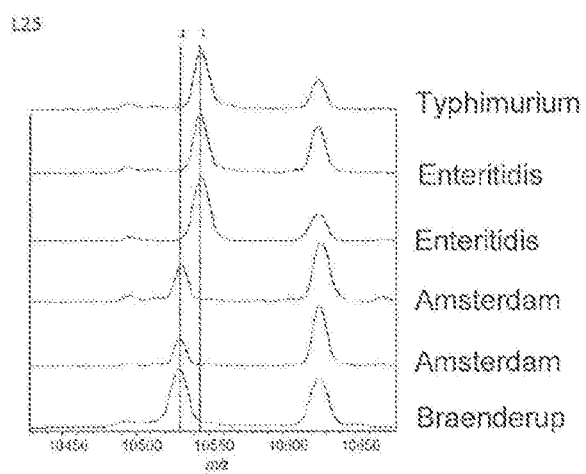
FIG. 20 is a peak chart of ribosomal protein L25.
Figure 21:
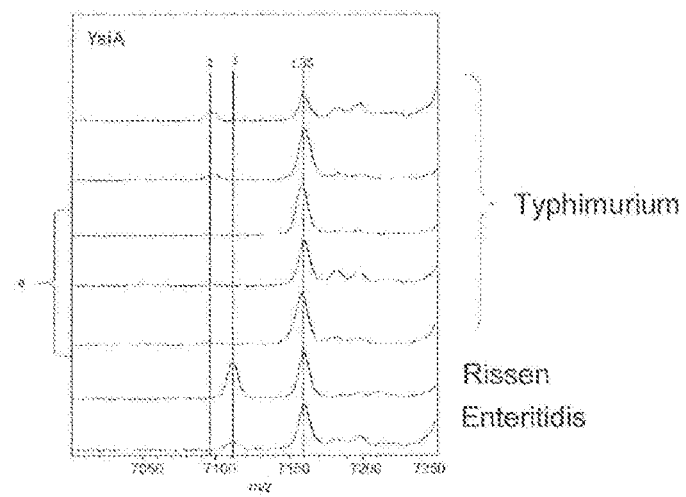
FIG. 21 is a peak chart of ribosomal protein YaiA.
Figure 22:
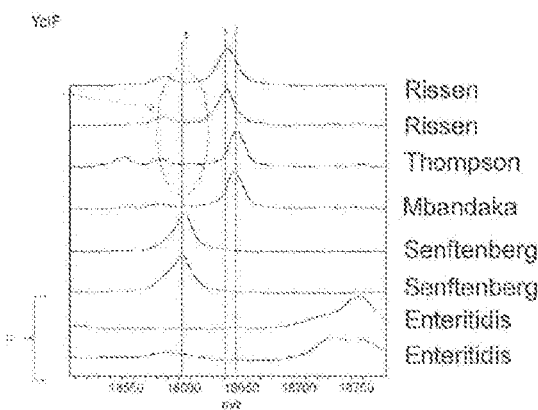
FIG. 22 is a peak chart of ribosomal protein YciF.

Hereinafter, a specific embodiment of the microorganism identification method according to the present invention will be described.

FIG. 1 is an overview of a microorganism identification system used for a microorganism identification method according to the present invention. This microorganism identification system is roughly composed of a mass spectrometry unit 10 and a microorganism discrimination unit 20. The mass spectrometry unit 10 includes an ionization section 11 for ionizing molecules and atoms in a sample by a matrix-assisted laser desorption ionization (MALDI) method, a time-of-flight mass separator (TOF) 12 for separating various kinds of ions emitted from the ionization section 11 according to the mass-to-charge ratio.

The TOF 12 includes an extraction electrode 13 for extracting ions from the ionization section 11 and leading the ions to an ion flight space in the TOF 12, and a detector 14 for detecting ions mass-separated in the ion flight space.

The substance of the microorganism discrimination unit 20 is a computer such as a workstation or a personal computer, in which a Central Processing Unit (CPU) 21 that is a central processing unit, a memory 22, a display section 23 consisting of a Liquid Crystal Display (LCD) and the like, an input section 24 consisting of a keyboard, a mouse and the like, and a storage section 30 consisting of a mass storage device such as a hard disk and a SSD (Solid State Drive) are connected to each other. In the storage section 30, an Operating System (OS) 31, a spectrum generation program 32, a genus/species decision program 33, and a subclass decision program 35 (program according to the present invention) are stored, and also a first database 34 and a second database 36 are housed. The microorganism discrimination unit 20 further includes an interface (I/F) 25 for direct connection with an external device and for controlling connection with an external device or the like via a network such as a LAN (Local Area Network), and is connected to the mass spectrometry unit 10 via a network cable NW (or wireless LAN) from the interface 25.

In FIG. 1, the spectrum acquisition part 37, the m/z reading part 38, the subclass determination part 39, the cluster analysis part 40, and the dendrogram (system diagram) generation part 41 are shown as related with the subclass decision program 35. Basically, these are all functional means realized by software by the CPU 21 executing the subclass decision program 35. The subclass decision program 35 is not necessarily a single program but may be a function incorporated in a part of a program for controlling the genus/species decision program 33 or the mass spectrometry unit 10, for example, and its form is not particularly limited. As the genus/species decision program 33, for example, a program for performing microorganism identification by a conventional fingerprint method or the like can be used.

Also, in FIG. 1, a configuration in which the spectrum generation program 32, the genus/species decision program 33, and the subclass decision program 35, the first database 34, and the second database 36 are mounted on the terminal operated by the user is shown. However, a configuration in which at least part or all of them is provided in another device connected to the terminal via the computer network, and processing according to a program provided in the another device and/or access to the database is executed according to an instruction from the terminal may be used.

A large number of mass lists related to known microorganisms are registered in the first database 34 of the storage section 30. This mass list lists the mass-to-charge ratios of ions detected upon mass spectrometry of certain microbial cells. In addition to the information of the mass-to-charge ratio, at least, information (classification information) of the classification group (family, genus, species, etc.) to which the microbial cells belong is contained. Such mass list is desirably created on the basis of data (measured data) obtained by actually subjecting various microbial cells to mass spectrometry in advance by the same ionization method and mass separation method as those by the mass spectrometry unit 10.

When creating a mass list from the measured data, first, a peak appearing in a predetermined mass-to-charge ratio range is extracted from the mass spectrum acquired as the measured data. At this time, by setting the mass-to-charge ratio range to about 2,000 to 35,000, it is possible to mainly extract a protein-derived peak. Also, by extracting only peaks whose height (relative intensity) is equal to or greater than a predetermined threshold, undesirable peaks (noise) can be excluded. Since the ribosomal protein group is expressed in a large amount in the cell, most of the mass-to-charge ratio described in the mass list can be derived from the ribosomal protein by appropriately setting the threshold. Then, the mass-to-charge ratios (m/z) of the peaks extracted as above are listed for each cell and registered in the first database 34 after adding the classification information and the like. In order to suppress variations in gene expression due to culture conditions, it is desirable to standardize culture conditions in advance for each microbial cell used for collecting the measured data.

In the second database 36 of the storage section 30, information on marker proteins for identifying known microorganisms by a classification (subspecies, pathotype, serovar, strain, etc.) lower than the species is registered. Information on the marker protein includes at least information on the mass-to-charge ratio (m/z) of the marker protein in the known microorganisms. In the second database 36 in the present embodiment, the values of mass-to-charge ratio m/z derived from at least 12 types of ribosomal proteins S8, L15, L17, L21, L25, S7, SODa, Peptidylpropyl isomerase, gns, YibT, YaiA and YciF are stored, as information on a marker protein for determining which serovar of *Salmonella* genus bacteria a test microorganism is. The values of mass-to-charge ratio of these ribosomal proteins will be described later.

It is desirable that the values of mass-to-charge ratio of the marker protein stored in the second database 36 are selected by comparing the calculated mass obtained by translating the base sequence of each marker protein into an amino acid sequence with the mass-to-charge ratio detected by actual measurement. The base sequence of the marker protein can be decided by sequence, or also can use a public database, for example, one acquired from a database of NCBI (National Center for Biotechnology Information) or the like. When obtaining the calculated mass from the above amino acid sequence, it is desirable to consider cleavage of the N-terminal methionine residue as a post-translational modification. Specifically, when the penultimate amino acid residue is Gly, Ala, Ser, Pro, Val, Thr or Cys, the theoretical value is calculated assuming that the N-terminal methionine is cleaved. In addition, since molecules added with protons are actually observed by MALDI-TOF MS, it is desirable to obtain the calculated mass also considering the protons (that is, the theoretical value of mass-to-charge ratio of ions obtained when each protein is analyzed by MALDI-TOF MS).

The procedure for identifying the serovar of *Salmonella* genus bacteria using the microorganism identification system according to this embodiment will be described with reference to a flowchart.

First, the user prepares a sample containing constituents of test microorganism, sets the sample in the mass spectrometry unit 10, and performs mass spectrometry. At this time, as the sample, in addition to a cell extract, or a cellular constituent such as a ribosomal protein purified from a cell extract, a bacterial cell or a cell suspension can be also used as it is.

The spectrum generation program 32 acquires a detection signal acquired from the detector 14 of the mass spectrometry unit 10 via the interface 25, and generates a mass spectrum of the test microorganism based on the detection signal (Step S101).

Next, the species decision program 33 collates the mass spectrum of the test microorganism with the mass lists of the known microorganisms recorded in the first database 34, and extracts a mass list of the test microorganism having a mass-to-charge ratio pattern similar to the mass spectrum of the test microorganism, for example, a mass list containing many peaks that coincide with each peak in the mass spectrum of the test microorganism in a predetermined error range (Step S102). The species decision program 33 subsequently refers to the classification information stored in the first database 34 in association with the mass list extracted in Step S102 to specify a species to which the known microorganism corresponding to the mass list belongs (Step S103). Then, when this species is not *Salmonella* genus bacteria (No in Step S104), the species is outputted to the display section 23 as a species of the test microorganism (Step S116), and the identification processing is terminated. On the other hand, when the species is *Salmonella* genus bacteria (Yes in Step S104), then the process proceeds to the identification processing by the subclass decision program 35. When it is determined in advance that the sample contains *Salmonella* genus bacteria by other methods, the process may proceeds to the subclass decision program 35 without utilizing the species decision program using the mass spectrum.

In the subclass decision program 35, first, the subclass determination part 39 reads out each of the values of mass-to-charge ratio of 12 types of ribosomal proteins S8, L15, L17, L21, L25, S7, SODa, Peptidylpropyl isomerase, gns, YibT, YaiA and YciF from the second database 36 (Step S105). Subsequently, the spectrum acquisition part 37 acquires the mass spectrum of the test microorganism generated in Step S101. Then, the m/z reading part 38 selects peaks appearing in the mass-to-charge ratio range stored in the second database 36 in association with each marker protein on the mass spectrum as peaks corresponding to each marker protein, and reads the mass-to-charge ratio (Step S106). And, cluster analysis using the read mass-to-charge ratio as an index is performed. Specifically, the subclass determination part 39 compares the mass-to-charge ratio with the values of mass-to-charge ratio of each marker protein read out from the second database 36 and decides attribution of the protein with respect to the read mass-to-charge ratio (Step S107). Then, cluster analysis is performed based on the decided attribution to determine the serovar of the test microorganism (Step S108), and the result is output to the display section 23 as the identification result of the test microorganism (Step S109).

Although the embodiments for carrying out the present invention have been described above with reference to the drawings, the present invention is not limited to the above-described embodiments, and appropriate modifications are permitted within the scope of the gist of the present invention.

EXAMPLES (1) Strains Used

As described in FIG. 3, a total of 64 strains of *Salmonella* available from the National Institute of Technology and Evaluation Nite Biological Resource Center (NBRC), Microbe Division/Japan Collection of Microorganisms (JCM) RIKEN BioResource Research Center (Tsukuba), National Bioresource Project GTC Collection (Gifu) and the American Type Culture Collection (Manassas, VA, USA) that are strain culture collection, isolates from Japan Food Research Laboratories and isolates from Hyogo Prefectural Institute of Public Health science were used for analysis. The serovar of *Salmonella enterica* subsp. *enterica* was decided by multiplex PCR method reported by *Salmonella* immune serum "Seiken" (DENKA SEIKEN Co., Ltd.) and Non Patent Literatures 3 and 4. The strains were classified into 22 serovars by this method. FIG. 4 shows relationships between O-antigen immune serum and a serovar.

(2) Analysis of DNA

Among the primers used in *Escherichia coli* database creation (Non Patent Literature 11), those which cannot be shared with *Salmonella* genus bacteria were designed based on consensus sequences. The designed primers are shown in FIG. 5. Using these primers, DNA sequences of S10-spcalpha operon and protein genes that could be biomarkers were analyzed. Specifically, genomic extraction was performed from each strain by a conventional method, and PCR was carried out using KOD plus as a template to amplify a target gene region. The obtained PCR product was purified and used as a template for sequence analysis. Sequence analysis was performed using Big Dye ver. 3.1 Cycle Sequencing Kit (Applied Biosystems, Foster City, California, USA). The DNA sequence of the gene was converted to the amino acid sequence of each gene, and the mass-to-charge ratio was calculated based on the amino acid mass in FIG. 6 to obtain a theoretical mass value.

(3) Analysis by MALDI-TOF MS

Bacterial cells grown in Luria Agar medium (Sigma-Aldrich Japan, Tokyo, Japan) were recovered and approximately 2 colonies of bacterial cells were added in 10 μL of a sinapinic matrix agent (25 mg/mL sinapinic acid (Wako Pure Chemical Industries, Ltd., Osaka, Japan) in 50 v/v % acetonitrile and 0.6 v/v % trifluoroacetic acid solution) and stirred well, and 1.2 μL out of the solution was loaded on a sample plate and air-dried. For MALDI-TOF MS measurement, the sample was measured in positive linear mode, at spectral range of 2000 m/z to 35000 m/z using AXIMA microorganism identification system (Shimadzu Corporation, Kyoto City, Japan). The above-described calculated mass was matched with the measured mass-to-charge ratio with a tolerance of 500 ppm, and proper modification was made. The calibration of the mass spectrometer was performed according to the instruction manual, using *Escherichia coli* DH5a strain.

(4) Construction of *Salmonella enterica* Subsp. *enterica* Database

By comparing the theoretical mass values of the ribosomal proteins obtained in the above (2) with the peak chart by MALDI-TOF MS obtained in (3), it was confirmed that there was no difference between the theoretical values obtained from gene sequences and the measured values, regarding the protein which could be detected by actual measurement. The theoretical and measured values of the ribosomal proteins in the S10-spc-α operon and proteins that can be other biomarkers showing different masses depending on the strain are summarized as a database as shown in FIGS. 7A to 7G.

The numbers shown in FIGS. 7A to 7G are the theoretical mass of the mass-to-charge ratio (m/z) obtained from genes. In addition, symbols "○", "Δ", and "x" represent mass peak detection results in actual measurement. Specifically, the symbol "○" indicates that it was detected as a peak within the 500 ppm range of the theoretical value at the default peak processing setting (threshold offset; 0.015 mV, threshold response; 1.200) of AXIMA microorganism identification system, and the symbol "x" indicates that there was a case where a peak could not be detected. In addition, the symbol "Δ" means that the theoretical mass difference in each strain or the difference from other protein peaks was 500 ppm or less, respectively, and the mass difference could not be identified even when a peak was detected.

As can be seen from FIGS. 7A to 7G, it was showed that the theoretical mass values of the ribosomal proteins L23, L16, L24, S8, L6, S5, L15 and L17 encoded in the s10-spc-alpha operon and L21, L25, S7, SODa, gns, YibT, Peptidylpropyl isomerase, YaiA and YciF outside the operon (total 17 types) differ depending on the strain of *Salmonella enterica* subsp. *enterica*, thus are possibly useful protein markers that can be used for serovar identification of *Salmonella enterica* subsp. *enterica*.

However, while it can be seen that L23, L16, L24, L6 and S5 have strains whose theoretical mass differences are separated by 500 ppm or more and can be a powerful biomarker for identification of these strains, there was a strain that could not be detected in actual measurement.

On the other hand, a total of seven types of proteins, S8, L15, L17, L21, L25, S7 and Peptidylpropyl isomerase, were stably detected irrespective of the strains, and the mass difference by the strains was also 500 ppm or more. Therefore, these proteins were found useful as biomarkers for serovar identification of *Salmonella enterica* subsp. *enterica* in MALDI-TOF MS.

SODa is an important biomarker for serovar identification of *Salmonella enterica* subsp. *enterica*, but the genotypes were varied and seven different mass-to-charge ratios were confirmed. All of these mass-to-charge ratios are as large as m/z around 23000, and in this region, the analysis accuracy of currently provided MALDI-TOF MS is low unless the difference between the other mass-to-charge ratios is 800 ppm or more, thus SODa cannot identify the serovars. Therefore, four types that can identify the serovar at this time were used as biomarkers. Regarding gns, YibT, YaiA and YciF, contamination peaks exist in one of the theoretical mass values, but since serovars *infantis*, Thompson and Typhimurium are proteins that are mutated specifically, only the theoretical mass value without contamination peak was used as a biomarker. Therefore, 12 types of proteins were used as biomarkers for *Salmonella enterica* subsp. *enterica* serovar identification.

(5) Attribution of Measured Values of MALDI-TOFMS by Software

Based on the above, using a total of 12 types of proteins, 8 types of proteins S8, L15, L17, L21, L25, S7, SODa and Peptidylpropyl isomerase that are stably detected regardless of the strain and 4 types of proteins gns, YibT, YaiA and YciF, as biomarkers, their theoretical mass values were registered in the software as shown in Patent Literature 2.

5: 22962.8 that was within the mass difference of 800 ppm of SODa was registered as the closest 1: 22948.82, and 6: 22996.82 and 7: 23004.88 as 2: 23010.84. In addition, gns, YibT, YaiA and YciF in which contamination peaks exist are registered as 6483.51, 8023.08, 7110.89 and 18643.13/18653.16, respectively.

Next, measured data in MALDI-TOF MS was analyzed with this software, and whether each biomarker was correctly attributed as a registered mass peak was examined. As a result, as shown in FIGS. 8A to 8G, all biomarker mass peaks of all the strains were attributed as registered mass numbers. Each attribution mass pattern was classified into groups 1 to 31, and compared with the serovar of each strain. Then, it was found that Typhimurium belongs to 1, 2 and 3, O4 group with unknown serovar to 4 and 5, Saintpaul to 6, O18 group with unknown serovar to 7, Orion to 8, Braenderup to 9, Montevideo and Schwarzengrund to 10, Schwarzengrund to 11, Abony and Pakistan to 12, Enteritidis to 13 and 14, Rissen to 15, *Gallinarum pullorum* to 16, Altona to 17, Amsterdam to 18, *infantis* to 19 and 20, Istanbul to 21, O4 group with unknown serovar to 22, Manhattan to 23, Mbandaka to 24, Senftenberg and O1, 3 and 19 groups with unknown serovar to 25, Thompson to 26, O4 group with unknown serovar to 27, O7 group with unknown serovar to 28, Brandenburg, Minnesota and Saintpaul to 29, Brandenburg and Saintpaul to 30, and *choleraesuis* strain to 31.

Based on the above, it was found that use of the mass of S8 (m/z 13996.36 or 14008.41), L15 (m/z 14967.38, 14981.41 or 14948.33), L17 (m/z 14395.61 or 14381.59), L21 (m/z 11579.36 or 11565.33), L25 (m/z 10542.19 or 10528.17), S7 (m/z 17460.15, 17474.18 or 17432.1), SODa (m/z 22948.82, 23010.84, 22976.83 or 22918.79), Peptidylpropyl isomerase (m/z 10198.07 or 10216.11), gns (m/z6483.51), YibT (m/z 8023.08), YaiA (m/z 7110.89) and YciF (m/z 18643.13) as biomarkers for MALDI-TOF MS analysis is useful for serovar identification of *Salmonella enterica* subsp. *enterica*.

Among the biomarkers found out this time, 10 types except S8 and Peptidylpropyl isomerase have been reported in Non Patent Literature 10. However, Non Patent Literature 10 requires confirmation of each peak one by one, thus takes time for spectral analysis of MALDI-TOF MS for identifying serovar. Also, as to the mass-to-charge ratio m/z 6036 reported to be an important peak for identification of Enteriridis in Non Patent Literature 10, a peak was not confirmed in 5 strains out of 32 strains in Non Patent Literature 10, and in this example, a peak could not be confirmed in 8 strains out of 35 strains. Therefore, it was not used as a biomarker for serovar identification of *Salmonella enterica* subsp. *enterica*.

By adding S8 and Peptidylpropyl isomerase to the biomarkers and using 12 types of carefully selected proteins as biomarkers, it became possible to provide a database that automatically identifies *Salmonella enterica* subsp. *enterica* to 31 groups for the first time.

(6) Comparison with Fingerprint Method (SARAMIS)

In fact, the identification result by the existing fingerprint method (SARAMIS) was compared with the identification result using the biomarker theoretical mass value shown in Table 6 as indices. First, in actual measurement in MALDI-TOF MS, a chart as shown in FIG. 9 was obtained. This result was analyzed by SARAMIS according to the instruction manual of AXIMA microorganism identification system. Results thus obtained are shown in FIG. 10A and FIG. 10B. As can be seen from these figures, all *Salmonella* genus bacteria used in the sample were identified as *Salmonella enterica* subsp. *enterica* in 91% to 99.9%, and species identification and serovar identification were not performed.

Therefore, whether measurement results of strains of different subspecies can be identified based on the theoretical mass database shown in FIG. 8A was attempted. FIGS. 11 to 22 are enlarged views of 12 types of biomarker peak portions of the charts of FIG. 8. As can be seen from FIGS. 11 to 22, peaks can be distinguished since each biomarker mass is shifted. When compared with the measured values of 12 types of biomarkers and attributed, they agreed with the results shown in FIGS. 8A to 8D.

Figure 23:
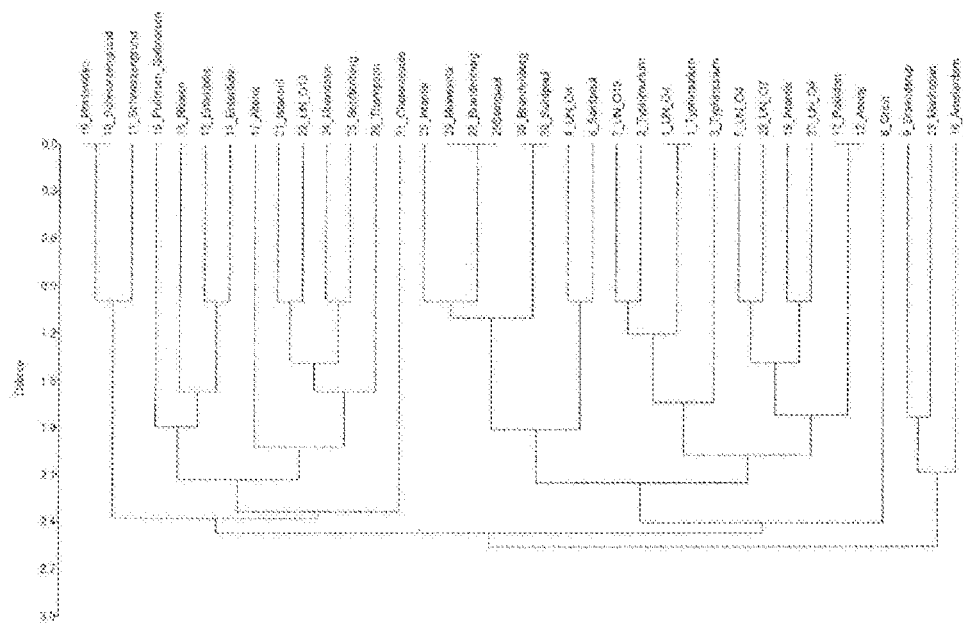
FIG. 23 is a dendrogram generated using 12 types of ribosomal proteins.

Next, cluster analysis was performed using the attribution results of 12 types of ribosomal proteins, and dendrogram was generated. The results are shown in FIG. 23. In this method, although serovars of *infantis*, Brandenburg, Minnesota and Saintpaul could not be identified, other serovars could be almost identified.

Based on the above, the following can be seen.

SODa, S7 and gns are involved in the identification of multiple serovars and are particularly important as biomarkers for serovar identification of *Salmonella enterica* subsp. *enterica*.

Moreover, Enteritidis, Mbandaka and *choleraesuis* can be identified from other serovars by combination of SODa and S7 mutation.

Furthermore, *infantis* is identified, and Enteritidis and Mbandaka are identified by gns.

Typhimurium, which is the top of serovar responsible for nontyphoidal *Salmonella* infections, is separated by YaiA, and Thompson by YibT. Also, Pullorm (*gallinarum*) is identified by L17, Rissen by S8, Orion by Peptidylpropyl isomerase, and Altona by L15. L25 separates *infantis* and Amsterdam, and L21 is important to identify Montevideo and Shwarzengrund, Minnesota. YciF is important for identification of *infantis*.

(7) Gene Sequence and Amino Acid Sequence of Biomarkers

DNA sequences and amino acid sequences in each strain of a total of 12 types of ribosomal proteins, S8, L15 and L17 encoded in the S10-spc-alpha operon and SODa, L21, L25, S7, gns, YibT, Peptidylpropyl isomerase and YciF outside the operon, which exhibit theoretical mass values different depending on the strain of *Salmonella enterica* subsp. *enterica*, are summarized in FIGS. 24 to 47.

REFERENCE SIGNS LIST

10 . . . Mass Spectrometry Unit
11 . . . Ionization Section
12 . . . TOF
13 . . . Extraction Electrode
14 . . . Detector
20 . . . Microorganism Discrimination Unit
21 . . . CPU
22 . . . Memory
23 . . . Display Section
24 . . . Input Section
25 . . . I/F
30 . . . Storage Section
31 . . . OS
32 . . . Spectrum Generation Program
33 . . . Genus/Species Decision Program
34 . . . First Database
35 . . . Subclass Decision Program
36 . . . Second Database
37 . . . Spectrum Acquisition Part
38 . . . m/z Reading Part
39 . . . Subclass Determination Part
40 . . . Cluster Analysis Part
41 . . . Dendrogram Generation Part

SEQUENCE LISTING (1095 sequences)

SEQ ID NO: 1 - DNA, 20 bp, synthetic construct
  misc_feature 1..20: note = PCR primer
  source 1..20: mol_type = other DNA
aagaacggttacactctccc

SEQ ID NO: 2 - DNA, 23 bp, synthetic construct
  misc_feature 1..23: note = PCR primer
  source 1..23: mol_type = other DNA
atgtcgcctacgcctgcgtagcg

SEQ ID NO: 3 - DNA, 23 bp, synthetic construct
  misc_feature 1..23: note = PCR primer
  source 1..23: mol_type = other DNA
gctggcatgattcgtgaagaacg

SEQ ID NO: 4 - DNA, 21 bp, synthetic construct
  misc_feature 1..21: note = PCR primer
  source 1..21: mol_type = other DNA
tgctgaagtaactggttccgg

SEQ ID NO: 5 - DNA, 23 bp, synthetic construct
  misc_feature 1..23: note = PCR primer
  source 1..23: mol_type = other DNA
cataacgtagaaatgaaaccagg

SEQ ID NO: 6 - DNA, 20 bp, synthetic construct
  misc_feature 1..20: note = PCR primer
  source 1..20: mol_type = other DNA
agcgtcgctgatgttacaac

SEQ ID NO: 7 - DNA, 21 bp, synthetic construct
  misc_feature 1..21: note = PCR primer
  source 1..21: mol_type = other DNA
atcaatcgtaatgggtgtgag

SEQ ID NO: 8 - DNA, 22 bp, synthetic construct
  misc_feature 1..22: note = PCR primer
  source 1..22: mol_type = other DNA
aagccggaagcgggtcactttg

SEQ ID NO: 9 - DNA, 20 bp, synthetic construct
  misc_feature 1..20: note = PCR primer
  source 1..20: mol_type = other DNA
ctttttgactgtggtcctgc

SEQ ID NO: 10 - DNA, 20 bp, synthetic construct
  misc_feature 1..20: note = PCR primer
  source 1..20: mol_type = other DNA
cgttctctcaagaaaggtcc

SEQ ID NO: 11 - DNA, 20 bp, synthetic construct
  misc_feature 1..20: note = PCR primer
  source 1..20: mol_type = other DNA
gccgattacaccataagtgg

SEQ ID NO: 12 - DNA, 22 bp, synthetic construct
  misc_feature 1..22: note = PCR primer
  source 1..22: mol_type = other DNA
tagcacgacgtgctgcttcgat

SEQ ID NO: 13 - DNA, 23 bp, synthetic construct
  misc_feature 1..23: note = PCR primer
  source 1..23: mol_type = other DNA
tccgtactctgcaaggtcgcgtg

SEQ ID NO: 14 - DNA, 23 bp, synthetic construct
  misc_feature 1..23: note = PCR primer
  source 1..23: mol_type = other DNA
actccggtgcacgtcgcgtaatg

SEQ ID NO: 15 - DNA, 20 bp, synthetic construct
  misc_feature 1..20: note = PCR primer
  source 1..20: mol_type = other DNA
agcagtctgcgtttcagctc

SEQ ID NO: 16 - DNA, 21 bp, synthetic construct
  misc_feature 1..21: note = PCR primer
  source 1..21: mol_type = other DNA
attgttgaaggtatcaacctg

SEQ ID NO: 17 - DNA, 20 bp, synthetic construct
  misc_feature 1..20: note = PCR primer
  source 1..20: mol_type = other DNA
ttaccggttaacacgataac

SEQ ID NO: 18 - DNA, 19 bp, synthetic construct
  misc_feature 1..19: note = PCR primer
  source 1..19: mol_type = other DNA
tcgtggtaactacagcatg

SEQ ID NO: 19 - DNA, 20 bp, synthetic construct
  misc_feature 1..20: note = PCR primer
  source 1..20: mol_type = other DNA
accatgccttcctccaagct

SEQ ID NO: 20 - DNA, 20 bp, synthetic construct
  misc_feature 1..20: note = PCR primer
  source 1..20: mol_type = other DNA
atgctgcccgtgaagctggc

SEQ ID NO: 21 - DNA, 21 bp, synthetic construct
  misc_feature 1..21: note = PCR primer
  source 1..21: mol_type = other DNA
atcggtcgtctgccgaaacac

SEQ ID NO: 22 - DNA, 21 bp, synthetic construct
  misc_feature 1..21: note = PCR primer
  source 1..21: mol_type = other DNA
gtcaccatgccttcctccaag

SEQ ID NO: 23 - DNA, 21 bp, synthetic construct
  misc_feature 1..21: note = PCR primer
  source 1..21: mol_type = other DNA
aatgtgtatcaaggttctggg

SEQ ID NO: 24 - DNA, 22 bp, synthetic construct
  misc_feature 1..22: note = PCR primer
  source 1..22: mol_type = other DNA
cttcactaagaagctgcagctg

SEQ ID NO: 25 - DNA, 20 bp, synthetic construct
  misc_feature 1..20: note = PCR primer
  source 1..20: mol_type = other DNA
atatccaaaccacgaacgcg

SEQ ID NO: 26 - DNA, 23 bp, synthetic construct
  misc_feature 1..23: note = PCR primer
  source 1..23: mol_type = other DNA
gatgtgagccatcttacacctct

SEQ ID NO: 27 - DNA, 22 bp, synthetic construct
  misc_feature 1..22: note = PCR primer
  source 1..22: mol_type = other DNA
tgcggacattaacgaacacctg

SEQ ID NO: 28 - DNA, 22 bp, synthetic construct
  misc_feature 1..22: note = PCR primer
  source 1..22: mol_type = other DNA
tgcctacaatgttgaagcagcg

SEQ ID NO: 29 - DNA, 21 bp, synthetic construct
  misc_feature 1..21: note = PCR primer
  source 1..21: mol_type = other DNA
aatcatcaagacgaccctgcc

SEQ ID NO: 30 - DNA, 21 bp, synthetic construct
  misc_feature 1..21: note = PCR primer
  source 1..21: mol_type = other DNA
cgcgatagcaaccaagatcca

SEQ ID NO: 31 - DNA, 21 bp, synthetic construct
  misc_feature 1..21: note = PCR primer
  source 1..21: mol_type = other DNA
cgcgaacgccagacttaagga

SEQ ID NO: 32 - DNA, 21 bp, synthetic construct
  misc_feature 1..21: note = PCR primer
  source 1..21: mol_type = other DNA
actctgtcacagaaccctgca

SEQ ID NO: 33 - DNA, 22 bp, synthetic construct
  misc_feature 1..22: note = PCR primer
  source 1..22: mol_type = other DNA
tgtactggctgatcttacgacg

SEQ ID NO: 34 - DNA, 20 bp, synthetic construct
  misc_feature 1..20: note = PCR primer
  source 1..20: mol_type = other DNA
ggttcatccaacgctggcag

SEQ ID NO: 35 - DNA, 20 bp, synthetic construct
  misc_feature 1..20: note = PCR primer
  source 1..20: mol_type = other DNA
atatgacgctctgcccactg

SEQ ID NO: 36 - DNA, 22 bp, synthetic construct
  misc_feature 1..22: note = PCR primer
  source 1..22: mol_type = other DNA
gccgtaacgtttataaccctgg

SEQ ID NO: 37 - DNA, 21 bp, synthetic construct
  misc_feature 1..21: note = PCR primer
  source 1..21: mol_type = other DNA
acacgtcaaccggataatgca

SEQ ID NO: 38 - DNA, 19 bp, synthetic construct
  misc_feature 1..19: note = PCR primer
  source 1..19: mol_type = other DNA
atgaaccaactgcttacgc

SEQ ID NO: 39 - DNA, 20 bp, synthetic construct
  misc_feature 1..20: note = PCR primer
  source 1..20: mol_type = other DNA
cgttaccgtatgcgttgtgt

SEQ ID NO: 40 - DNA, 20 bp, synthetic construct
  misc_feature 1..20: note = PCR primer
  source 1..20: mol_type = other DNA
gcacagccacacgggtatat

SEQ ID NO: 41 - DNA, 20 bp, synthetic construct
  misc_feature 1..20: note = PCR primer
  source 1..20: mol_type = other DNA
cacttgtcaaagccgtgcaa

SEQ ID NO: 42 - DNA, 20 bp, synthetic construct
  misc_feature 1..20: note = PCR primer
  source 1..20: mol_type = other DNA
gtaaaaagccccgcaacagg

SEQ ID NO: 43 - DNA, 20 bp, synthetic construct
  misc_feature 1..20: note = PCR primer
  source 1..20: mol_type = other DNA
gcgattgaaggtaaccgctt

SEQ ID NO: 44 - DNA, 20 bp, synthetic construct
  misc_feature 1..20: note = PCR primer
  source 1..20: mol_type = other DNA
atgtgcgcactgataccgat

SEQ ID NO: 45 - DNA, 21 bp, synthetic construct
  misc_feature 1..21: note = PCR primer
  source 1..21: mol_type = other DNA
gtcgtcagggttgactatact

SEQ ID NO: 46 - DNA, 21 bp, synthetic construct
  misc_feature 1..21: note = PCR primer
  source 1..21: mol_type = other DNA
gcacagggcgactagatttag

SEQ ID NO: 47 - DNA, 22 bp, synthetic construct
  misc_feature 1..22: note = PCR primer
  source 1..22: mol_type = other DNA
gccctcgctgaattgctttttc

SEQ ID NO: 48 - DNA, 22 bp, synthetic construct
  misc_feature 1..22: note = PCR primer
  source 1..22: mol_type = other DNA
catgacgacactgtcttattgc

SEQ ID NO: 49 - DNA, 20 bp, synthetic construct
  misc_feature 1..20: note = PCR primer
  source 1..20: mol_type = other DNA
tcggtaaaccagtcaccact

SEQ ID NO: 50 - DNA, 22 bp, synthetic construct
  misc_feature 1..22: note = PCR primer
  source 1..22: mol_type = other DNA
taaactcaaataagcgrccgcg

SEQ ID NO: 51 - DNA, 21 bp, synthetic construct
  misc_feature 1..21: note = PCR primer
  source 1..21: mol_type = other DNA
tacgccatgcaaattcagcgc

SEQ ID NO: 52 - DNA, 23 bp, synthetic construct
  misc_feature 1..23: note = PCR primer
  source 1..23: mol_type = other DNA
aaaatcaagcagacgatgtaggc

SEQ ID NO: 53 - DNA, 22 bp, synthetic construct
  misc_feature 1..22: note = PCR primer
  source 1..22: mol_type = other DNA
gtctgacggcctaaggagtgat

SEQ ID NO: 54 - DNA, 393 bp, Salmonella enterica
  source 1..393: mol_type = genomic DNA
atgagcatgcaagatccgatcgcggatatgctgacccgtatccgtaacggtcaggccgcgaacaaagctgcggtcaccatgccttcctccaagctgaaagtggcaattgccaacgtgctgaaggaagaaggttttattgaagattttaaagttgaaggcgacaccaagccggaactggaactgactcttaagtatttccagggtaaagctgttgtagaaagcattcagcgtgtcagccgcccaggtctgcgcatctacaaacgtaaagatgagctgccgaaagttatggccggtctgggtatcgcagttgtttctacctctaaaggtgttatgactgatcgtgcagcgcgccaggctggtcttggtggcgaaattatctgctacgtagcctaa

SEQ ID NO: 55 - DNA, 435 bp, Salmonella enterica
  source 1..435: mol_type = genomic DNA
atgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgcaaagcagcgattacagccgaagttcgtctgtctgacctggcgaaagtagaaggcggcgttgtagacctgaacacgctgaaagcggcaaacattatcggtatccagatcgagttcgcgaaagtgatcctggctggcgaagtcactactccggtaactgttcgtggcctgcgtgttactaaaggcgctcgtgctgctatcgaagctgctggcggtaaaatcgaggaataa

SEQ ID NO: 56 - DNA, 384 bp, Salmonella enterica
  source 1..384: mol_type = genomic DNA
atgcgccatcgtaagagtggtcgtcaactgaaccgcaacagcagccatcgccaggctatgttccgcaacatggcaggttcactggttcgtcatgaaatcatcaagacgaccctgcctaaagcgaaagagctgcgtcgcgtagttgagccgctgattactcttgccaagactgatagcgttgctaatcgtcgtctggcattcgcccgtactcgtgataacgagatcgtggcaaaactgtttaacgagctgggcccgcgtttcgcgagccgcgccggtggttacactcgcattctgaagtgtggcttccgtgcaggcgacaacgcgccgatggcatacatcgagctggttgatcgttcagagaaaacagaagctgctgcagagtaa

SEQ ID NO: 57 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgccagcctgccggttgaagaactgattactaaactggaccaggtgccagcggacaaaaaaactgtgctgcgtaacaacgcgggcggccatgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggcctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 58 - DNA, 312 bp, Salmonella enterica
  source 1..312: mol_type = genomic DNA
atgtacgcggttttccaaagtggtggtaaacaacaccgagtaagcgaaggtcagaccgttcgcctggaaaagctggacatcgcaactggcgaaactatcgagttcgctgaagttctgatgatcgcaaacggtgaagaagtcaaaatcggcgttcctttcgttgatggcggcgtaatcaaagctgaagttgttgcccacggtcgtggcgagaaagttaaaatcgttaagtttcgtcgccgtaaacactaccgtaagcagcagggccatcgtcagtggttcactgatgtgaaaattaccggcatcagcgcttaa

SEQ ID NO: 59 - DNA, 285 bp, Salmonella enterica
  source 1..285: mol_type = genomic DNA
atgtttactatcaacgcagaagtacgtaaagagcagggtaagggtgcgagccgccgcctgcgcgccgctaacaagttcccggcaatcatctacggcggttctgaagccccgattgctatcgaactggaccacgaccaggtgatgaacatgcaagctaaagctgaattctacagcgaagttctgaccctcgttgttgacggtaaagaagtaaaagttaaagctcaggctgtacagcgtcacgcttacaaaccgaagctgactcacatcgacttcgttcgcgcgtaa

SEQ ID NO: 60 - DNA, 471 bp, Salmonella enterica
  source 1..471: mol_type = genomic DNA
atgccacgtcgtcgcgtcattggtcagcgtaaaattctgccggatccgaagttcggatcagaactgctggctaaatttgtcaatatcctgatggtagatggtaaaaaatctactgcagaatcaatcgtatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaaacgcggtgataaatccatggctctgcgcctggcgaacgaactttctgatgctgcagacaacaaaggtactgcagttaagaaacgtgaagacgttcaccgtatggcagaagccaacaaggcgttcgcacactaccgttggtaa

SEQ ID NO: 61 - DNA, 174 bp, Salmonella enterica
  source 1..174: mol_type = genomic DNA
atgaacagcgaagagttgacacataaagcagaagaggaaatcgcggcactcattagcaaaaaggttgccgaactacggaagaaaaccgggcaagaggtttccgaaatagagttcgcgccgcgagaaacgatgaaagggcttgagggataccacgttaaaattaaactactctag

SEQ ID NO: 62 - DNA, 210 bp, Salmonella enterica
  source 1..210: mol_type = genomic DNA
atggcaaaaataggtgagaacgtaccacttcttattgataaagccgtcgattttatggcgtccagccaggcgttccgtgaatacctgaataaaacgccgccgcgtgattatgttccttccgaggtgccgtcggagagcgcgcccatttatttgcagcgtctggaatattaccggcggctgtaccgaccaaaagaagaagaaagaggttaa

SEQ ID NO: 63 - DNA, 282 bp, Salmonella enterica
  source 1..282: mol_type = genomic DNA
atggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatacccagttcggttaccacatcattaaggtattgtatcgtaaataa

SEQ ID NO: 64 - DNA, 192 bp, Salmonella enterica
  source 1..192: mol_type = genomic DNA
atgccaaccagaccaccttatccgcgggaagcttatatcgtcaccattgaaaaaggcacgccgggccagacggtgacgtggtatcagctacgggctgaccatccgaaacctgattcgctcatcagcgagcatccgaccgcagaagaagcgatggatgcgaaaaatcgttacgaagatccggataaatcatag

SEQ ID NO: 65 - DNA, 504 bp, Salmonella enterica
  source 1..504: mol_type = genomic DNA
atgaatatcaaaaccgttgaagacctttttatccatctactttcagatacctatagtgcagaaaaacaattaaccaaggctcttcctaaacttgccagagccacgtccaatgaaaaattaagccaggcctttcaatctcatcttgaagaaacccagggtcagattgaacgtattgatcagatcgtcgaatctgaatctggcattaaactgaaaagaatgaaatgcgtcgctatggaagggctgattgaagaagccaatgaagtcatcgaaagtacggagaaaaacgaagtacgcgatgcagcgcttatcgccgcggcgcaaaaagtcgagcattacgaaatcgccagctacggcacgctagccaccctggccgagcagctcggctatagcaaagcattaaaactgctcaaagaaaccctcgacgaggaaaaacaaactgatttaaaacttaccgatttagcagtcagcaatgttaataaaagtgctgaacgcaaatcgaaataa

SEQ ID NO: 66 - DNA, 393 bp, Salmonella enterica; identical to SEQ ID NO: 54
  source 1..393: mol_type = genomic DNA

SEQ ID NO: 67 - DNA, 435 bp, Salmonella enterica
  source 1..435: mol_type = genomic DNA
atgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgcaaagcagcgattacagccgaagttcgtctgtctgacttggcgaaagtagaaggcggcgttgtagacctgaacacgctgaaagcggcaaacattatcggtatccagatcgagttcgcgaaagtgatcttggctggcgaagtcactactccggtaactgttcgtggcctgcgtgttactaaaggcgctcgtgctgctatcgaagctgctggcggtaaaatcgaggaataa

SEQ ID NO: 68 - DNA, 384 bp, Salmonella enterica; identical to SEQ ID NO: 56
  source 1..384: mol_type = genomic DNA

SEQ ID NO: 69 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacttgccagagtttgctgacctgccggttgaagaactgattactaaactggaccaggtgccagcggacaaaaaaaccgtgctgcgtaataacgcgggcggccacgctaaccacagcttcttctggaaaggcctgaaaaaaggcaccaccctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 70 - DNA, 312 bp, Salmonella enterica; identical to SEQ ID NO: 58
  source 1..312: mol_type = genomic DNA

SEQ ID NO: 71 - DNA, 285 bp, Salmonella enterica; identical to SEQ ID NO: 59
  source 1..285: mol_type = genomic DNA

SEQ ID NO: 72 - DNA, 471 bp, Salmonella enterica
  source 1..471: mol_type = genomic DNA
atgccacgtcgtcgcgtcattggtcagcgtaaaattctgccggatccgaagttcggatcagaactgctggctaaatttgtcaatatcctgatggtagatggtaaaaaatctactgcagaatcaatcgtatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaaacgcggtgataaatccatggctctgcgtctggcgaacgaactttctgacgctgcagaaaacaaaggtactgcagttaagaaacgtgaagacgttcaccgtatggcagaagccaacaaggcgttcgcacactaccgttggtaa

SEQ ID NO: 73 - DNA, 192 bp, Salmonella enterica
  source 1..192: mol_type = genomic DNA
atgccaaccagaccaccttatccgcgggaagcttatatcgtcaccattgaaaaaggcacgccgggccagacggtgacgtggtatcagctacgggctgaccatccgaaacctgattcgctcatcagcgagcatccgaccgcagaagaagcgatggatgcgaaaaaacgttacgaagatccggataaatcatag

SEQ ID NO: 74 - DNA, 504 bp, Salmonella enterica
  source 1..504: mol_type = genomic DNA
atgaatatcaaaaccgttgaagacctttttatccatctactttcagatacctatagtgcagaaaaacaattaaccaaggctctttctaaactagccagagccacgtccaatgaaaaattaagccaggcctttcaatctcatcttgaagaaacccagggtcagattgaacgtattgatcagatcgtcgaatctgaatctggcattaaactgaaaagaatgaaatgcgtcgctatggaagggctgatcgaagaagccaatgaagtcatcgaaagtacggagaaaaacgaagtacgcgatgcagcgcttatcgccgcggcgcaaaaagtcgagcattacgaaatcgccagctacggcacgctagccaccctggccgagcagctcggctatagcaaggcattaaaactgctcaaagaaaccctcgacgaggaaaaacaaactgatttaaaacttaccgatttagcagtcagcaatgttaataaaagtgctgaacgcaaatcgaaataa

SEQ ID NO: 75 - DNA, 393 bp, Salmonella enterica; identical to SEQ ID NO: 54
  source 1..393: mol_type = genomic DNA

SEQ ID NO: 76 - DNA, 435 bp, Salmonella enterica; identical to SEQ ID NO: 67
  source 1..435: mol_type = genomic DNA

SEQ ID NO: 77 - DNA, 384 bp, Salmonella enterica; identical to SEQ ID NO: 56
  source 1..384: mol_type = genomic DNA

SEQ ID NO: 78 - DNA, 621 bp, Salmonella enterica; identical to SEQ ID NO: 69
  source 1..621: mol_type = genomic DNA

SEQ ID NO: 79 - DNA, 312 bp, Salmonella enterica; identical to SEQ ID NO: 58
  source 1..312: mol_type = genomic DNA

SEQ ID NO: 80 - DNA, 285 bp, Salmonella enterica; identical to SEQ ID NO: 59
  source 1..285: mol_type = genomic DNA

SEQ ID NO: 81 - DNA, 471 bp, Salmonella enterica; identical to SEQ ID NO: 72
  source 1..471: mol_type = genomic DNA

SEQ ID NO: 82 - DNA, 393 bp, Salmonella enterica; identical to SEQ ID NO: 54
  source 1..393: mol_type = genomic DNA

SEQ ID NO: 83 - DNA, 435 bp, Salmonella enterica; identical to SEQ ID NO: 67
  source 1..435: mol_type = genomic DNA

SEQ ID NO: 84 - DNA, 384 bp, Salmonella enterica; identical to SEQ ID NO: 56
  source 1..384: mol_type = genomic DNA

SEQ ID NO: 85 - DNA, 621 bp, Salmonella enterica; identical to SEQ ID NO: 69
  source 1..621: mol_type = genomic DNA

SEQ ID NO: 86 - DNA, 312 bp, Salmonella enterica; identical to SEQ ID NO: 58
  source 1..312: mol_type = genomic DNA

SEQ ID NO: 87 - DNA, 285 bp, Salmonella enterica; identical to SEQ ID NO: 59
  source 1..285: mol_type = genomic DNA

SEQ ID NO: 88 - DNA, 471 bp, Salmonella enterica; identical to SEQ ID NO: 72
  source 1..471: mol_type = genomic DNA

SEQ ID NO: 89 - DNA, 393 bp, Salmonella enterica; identical to SEQ ID NO: 54
  source 1..393: mol_type = genomic DNA

SEQ ID NO: 90 - DNA, 435 bp, Salmonella enterica; identical to SEQ ID NO: 67
  source 1..435: mol_type = genomic DNA

SEQ ID NO: 91 - DNA, 384 bp, Salmonella enterica; identical to SEQ ID NO: 56
  source 1..384: mol_type = genomic DNA

SEQ ID NO: 92 - DNA, 621 bp, Salmonella enterica; identical to SEQ ID NO: 69
  source 1..621: mol_type = genomic DNA

SEQ ID NO: 93 - DNA, 312 bp, Salmonella enterica; identical to SEQ ID NO: 58
  source 1..312: mol_type = genomic DNA

SEQ ID NO: 94 - DNA, 285 bp, Salmonella enterica; identical to SEQ ID NO: 59
  source 1..285: mol_type = genomic DNA

SEQ ID NO: 95 - DNA, 471 bp, Salmonella enterica; identical to SEQ ID NO: 72
  source 1..471: mol_type = genomic DNA

SEQ ID NO: 96 - DNA, 174 bp, Salmonella enterica
  source 1..174: mol_type = genomic DNA
atgaacagcgaagagttgacacataaagcagaagaggaaatcgcggcactcattagcaaaaaggtcgccgaactacggaagaaaaccgggcaagaggtttccgaaatagagttcgcgccgcgagaaacgatgaaagggcttgagggataccacgttaaaattaaactactctag

SEQ ID NO: 97 - DNA, 210 bp, Salmonella enterica; identical to SEQ ID NO: 62
  source 1..210: mol_type = genomic DNA

SEQ ID NO: 98 - DNA, 282 bp, Salmonella enterica
  source 1..282: mol_type = genomic DNA
atggcaaaaatggcagcagcactgcatatccttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatacccagttcggttaccacatcattaaggtattgtatcgcaaataa

SEQ ID NO: 99 - DNA, 393 bp, Salmonella enterica; identical to SEQ ID NO: 54
  source 1..393: mol_type = genomic DNA

SEQ ID NO: 100 - DNA, 435 bp, Salmonella enterica; identical to SEQ ID NO: 67
  source 1..435: mol_type = genomic DNA

SEQ ID NO: 101 - DNA, 384 bp, Salmonella enterica; identical to SEQ ID NO: 56
  source 1..384: mol_type = genomic DNA

SEQ ID NO: 102 - DNA, 621 bp, Salmonella enterica; identical to SEQ ID NO: 69
  source 1..621: mol_type = genomic DNA

SEQ ID NO: 103 - DNA, 312 bp, Salmonella enterica; identical to SEQ ID NO: 58
  source 1..312: mol_type = genomic DNA

SEQ ID NO: 104 - DNA, 285 bp, Salmonella enterica; identical to SEQ ID NO: 59
  source 1..285: mol_type = genomic DNA

SEQ ID NO: 105 - DNA, 471 bp, Salmonella enterica; identical to SEQ ID NO: 72
  source 1..471: mol_type = genomic DNA

SEQ ID NO: 106 - DNA, 174 bp, Salmonella enterica; identical to SEQ ID NO: 96
  source 1..174: mol_type = genomic DNA

SEQ ID NO: 107 - DNA, 210 bp, Salmonella enterica; identical to SEQ ID NO: 62
  source 1..210: mol_type = genomic DNA

SEQ ID NO: 108 - DNA, 282 bp, Salmonella enterica
  source 1..282: mol_type = genomic DNA
atggcaaaaatggcagcagcactgcatatccttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatacccagttcggttaccacatcattaaagtattgtatcgcaaataa

SEQ ID NO: 109 - DNA, 393 bp, Salmonella enterica; identical to SEQ ID NO: 54
  source 1..393: mol_type = genomic DNA

SEQ ID NO: 110 - DNA, 435 bp, Salmonella enterica; identical to SEQ ID NO: 67
  source 1..435: mol_type = genomic DNA

SEQ ID NO: 111 - DNA, 384 bp, Salmonella enterica; identical to SEQ ID NO: 56
  source 1..384: mol_type = genomic DNA

SEQ ID NO: 112 - DNA, 621 bp, Salmonella enterica; identical to SEQ ID NO: 69
  source 1..621: mol_type = genomic DNA

SEQ ID NO: 113 - DNA, 312 bp, Salmonella enterica; identical to SEQ ID NO: 58
  source 1..312: mol_type = genomic DNA

SEQ ID NO: 114 - DNA, 285 bp, Salmonella enterica; identical to SEQ ID NO: 59
  source 1..285: mol_type = genomic DNA

SEQ ID NO: 115 - DNA, 471 bp, Salmonella enterica; identical to SEQ ID NO: 72
  source 1..471: mol_type = genomic DNA

SEQ ID NO: 116 - DNA, 393 bp, Salmonella enterica; identical to SEQ ID NO: 54
  source 1..393: mol_type = genomic DNA

SEQ ID NO: 117 - DNA, 435 bp, Salmonella enterica
  source 1..435: mol_type = genomic DNA
atgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgcaaagcagcgattacagccgaagttcgtctgtctgacttggcgaaagtagaaggcggcgttgtagacctgaacacgctgaaagcggcaaacattatcggtatccagatcgagttcgcgaaagtgatcctggctggcgaagtcactactccggtaactgttcgtggcctgcgtgttactaaaggcgctcgtgctgctatcgaagctgctggcggtaaaatcgaggaataa

SEQ ID NO: 118 - DNA, 384 bp, Salmonella enterica
  source 1..384: mol_type = genomic DNA
atgcgccatcgtaagagtggtcgtcaactgaaccgcaacagcagccatcgccaggctatgttccgcaacatggcaggttcactggttcgtcatgaaatcatcaagacgaccctgcctaaagcgaaagagctgcgtcgcgtagttgagccgctgattactcttgccaagactgatagcgttgctaatcgtcgtctggcattcgcccgtactcgtgataacgagatcgtggcaaaactgtttaacgatctgggcccgcgtttcgcgagccgcgccggtggttacactcgcattctgaagtgtggcttccgtgcaggcgacaacgcgccgatggcatacatcgagctggttgatcgctcagagaaaacagaagctgctgcagagtaa

SEQ ID NO: 119 - DNA, 621 bp, Salmonella enterica; identical to SEQ ID NO: 69
  source 1..621: mol_type = genomic DNA

SEQ ID NO: 120 - DNA, 312 bp, Salmonella enterica; identical to SEQ ID NO: 58
  source 1..312: mol_type = genomic DNA

SEQ ID NO: 121 - DNA, 285 bp, Salmonella enterica; identical to SEQ ID NO: 59
  source 1..285: mol_type = genomic DNA

SEQ ID NO: 122 - DNA, 471 bp, Salmonella enterica
  source 1..471: mol_type = genomic DNA
atgccacgtcgtcgcgtcattggtcagcgtaaaattctgccggatccgaagttcggatcagaactgctggctaaatttgtcaatatcctgatggtagatggtaaaaaatctactgcagaatcaatcgtatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaagcgcggtgataaatccatggctctgcgtctggcgaacgaactttctgacgctgcagaaaacaaaggtactgcagttaagaaacgtgaagacgttcaccgtatggcagaagccaacaaggcgttcgcacactaccgttggtaa

SEQ ID NO: 123 - DNA, 174 bp, Salmonella enterica
  source 1..174: mol_type = genomic DNA
atgaacagcgaagagttgacacataaagcagaagaggaaatcgcggcactcattagcaaaaaggtcgcagaactacggaagaaaaccgggcaagaggtttccgaaatagagttcgcgccgcgagaaacgatgaaagggcttgagggataccacgttaaaattaaactactctag

SEQ ID NO: 124 - DNA, 210 bp, Salmonella enterica
  source 1..210: mol_type = genomic DNA
atggcaaaaataggtgagaacgtaccacttcttattgataaagccgtcgattttaaggcgtccagccaggcgttccgtgaatacctgaataaaacgccgccgcgtgattatgttccttccgaggtgccgtcggagagcgcgcccatttatttgcagcgtctggaatattaccggcggctgtaccgaccaaaagaagaagaaagaggttaa

SEQ ID NO: 125 - DNA, 282 bp, Salmonella enterica; identical to SEQ ID NO: 108
  source 1..282: mol_type = genomic DNA

SEQ ID NO: 126 - DNA, 393 bp, Salmonella enterica; identical to SEQ ID NO: 54
  source 1..393: mol_type = genomic DNA

SEQ ID NO: 127 - DNA, 435 bp, Salmonella enterica; identical to SEQ ID NO: 67
  source 1..435: mol_type = genomic DNA

SEQ ID NO: 128 - DNA, 384 bp, Salmonella enterica; identical to SEQ ID NO: 56
  source 1..384: mol_type = genomic DNA

SEQ ID NO: 129 - DNA, 621 bp, Salmonella enterica; identical to SEQ ID NO: 69
  source 1..621: mol_type = genomic DNA

SEQ ID NO: 130 - DNA, 312 bp, Salmonella enterica; identical to SEQ ID NO: 58
  source 1..312: mol_type = genomic DNA

SEQ ID NO: 131 - DNA, 285 bp, Salmonella enterica; identical to SEQ ID NO: 59
  source 1..285: mol_type = genomic DNA

SEQ ID NO: 132 - DNA, 471 bp, Salmonella enterica; identical to SEQ ID NO: 72
  source 1..471: mol_type = genomic DNA

SEQ ID NO: 133 - DNA, 393 bp, Salmonella enterica; identical to SEQ ID NO: 54
  source 1..393: mol_type = genomic DNA

SEQ ID NO: 134 - DNA, 435 bp, Salmonella enterica; identical to SEQ ID NO: 55
  source 1..435: mol_type = genomic DNA

SEQ ID NO: 135 - DNA, 384 bp, Salmonella enterica; identical to SEQ ID NO: 56
  source 1..384: mol_type = genomic DNA

SEQ ID NO: 136 - DNA, 621 bp, Salmonella enterica; identical to SEQ ID NO: 57
  source 1..621: mol_type = genomic DNA

SEQ ID NO: 137 - DNA, 312 bp, Salmonella enterica; identical to SEQ ID NO: 58
  source 1..312: mol_type = genomic DNA

SEQ ID NO: 138 - DNA, 285 bp, Salmonella enterica; identical to SEQ ID NO: 59
  source 1..285: mol_type = genomic DNA

SEQ ID NO: 139 - DNA, 471 bp, Salmonella enterica; identical to SEQ ID NO: 60
  source 1..471: mol_type = genomic DNA

SEQ ID NO: 140 - DNA, 393 bp, Salmonella enterica; identical to SEQ ID NO: 54
  source 1..393: mol_type = genomic DNA

SEQ ID NO: 141 - DNA, 435 bp, Salmonella enterica; identical to SEQ ID NO: 55
  source 1..435: mol_type = genomic DNA

SEQ ID NO: 142 - DNA, 384 bp, Salmonella enterica; identical to SEQ ID NO: 56
  source 1..384: mol_type = genomic DNA

SEQ ID NO: 143 - DNA, 621 bp, Salmonella enterica; identical to SEQ ID NO: 57
  source 1..621: mol_type = genomic DNA

SEQ ID NO: 144 - DNA, 312 bp, Salmonella enterica; identical to SEQ ID NO: 58
  source 1..312: mol_type = genomic DNA

SEQ ID NO: 145 - DNA, 285 bp, Salmonella enterica; identical to SEQ ID NO: 59
  source 1..285: mol_type = genomic DNA

SEQ ID NO: 146 - DNA, 471 bp, Salmonella enterica; identical to SEQ ID NO: 60
  source 1..471: mol_type = genomic DNA

SEQ ID NO: 147 - DNA, 393 bp, Salmonella enterica; identical to SEQ ID NO: 54
  source 1..393: mol_type = genomic DNA

SEQ ID NO: 148 - DNA, 435 bp, Salmonella enterica; identical to SEQ ID NO: 55
  source 1..435: mol_type = genomic DNA

SEQ ID NO: 149 - DNA, 384 bp, Salmonella enterica; identical to SEQ ID NO: 56
  source 1..384: mol_type = genomic DNA

SEQ ID NO: 150 - DNA, 621 bp, Salmonella enterica; identical to SEQ ID NO: 57
  source 1..621: mol_type = genomic DNA

SEQ ID NO: 151 - DNA, 312 bp, Salmonella enterica; identical to SEQ ID NO: 58
  source 1..312: mol_type = genomic DNA

SEQ ID NO: 152 - DNA, 285 bp, Salmonella enterica; identical to SEQ ID NO: 59
  source 1..285: mol_type = genomic DNA

SEQ ID NO: 153 - DNA, 471 bp, Salmonella enterica; identical to SEQ ID NO: 60
  source 1..471: mol_type = genomic DNA

SEQ ID NO: 154 - DNA, 393 bp, Salmonella enterica; identical to SEQ ID NO: 54
  source 1..393: mol_type = genomic DNA

SEQ ID NO: 155 - DNA, 435 bp, Salmonella enterica; identical to SEQ ID NO: 55
  source 1..435: mol_type = genomic DNA

SEQ ID NO: 156 - DNA, 384 bp, Salmonella enterica; identical to SEQ ID NO: 56
  source 1..384: mol_type = genomic DNA

SEQ ID NO: 157 - DNA, 621 bp, Salmonella enterica; identical to SEQ ID NO: 57
  source 1..621: mol_type = genomic DNA

SEQ ID NO: 158 - DNA, 312 bp, Salmonella enterica; identical to SEQ ID NO: 58
  source 1..312: mol_type = genomic DNA

SEQ ID NO: 159 - DNA, 285 bp, Salmonella enterica; identical to SEQ ID NO: 59
  source 1..285: mol_type = genomic DNA

SEQ ID NO: 160 - DNA, 471 bp, Salmonella enterica; identical to SEQ ID NO: 60
  source 1..471: mol_type = genomic DNA

SEQ ID NO: 161 - DNA, 393 bp, Salmonella enterica; identical to SEQ ID NO: 54
  source 1..393: mol_type = genomic DNA

SEQ ID NO: 162 - DNA, 435 bp, Salmonella enterica; identical to SEQ ID NO: 55
  source 1..435: mol_type = genomic DNA

SEQ ID NO: 163 - DNA, 384 bp, Salmonella enterica; identical to SEQ ID NO: 56
  source 1..384: mol_type = genomic DNA

SEQ ID NO: 164 - DNA, 621 bp, Salmonella enterica; identical to SEQ ID NO: 57
  source 1..621: mol_type = genomic DNA

SEQ ID NO: 165 - DNA, 312 bp, Salmonella enterica; identical to SEQ ID NO: 58
  source 1..312: mol_type = genomic DNA

SEQ ID NO: 166 - DNA, 285 bp, Salmonella enterica; identical to SEQ ID NO: 59
  source 1..285: mol_type = genomic DNA

SEQ ID NO: 167 - DNA, 471 bp, Salmonella enterica; identical to SEQ ID NO: 60
  source 1..471: mol_type = genomic DNA

SEQ ID NO: 168 - DNA, 393 bp, Salmonella enterica; identical to SEQ ID NO: 54
  source 1..393: mol_type = genomic DNA

SEQ ID NO: 169 - DNA, 384 bp, Salmonella enterica; identical to SEQ ID NO: 56
  source 1..384: mol_type = genomic DNA

SEQ ID NO: 170 - DNA, 621 bp, Salmonella enterica; identical to SEQ ID NO: 57
  source 1..621: mol_type = genomic DNA

SEQ ID NO: 171 - DNA, 312 bp, Salmonella enterica; identical to SEQ ID NO: 58
  source 1..312: mol_type = genomic DNA

SEQ ID NO: 172 - DNA, 285 bp, Salmonella enterica; identical to SEQ ID NO: 59
  source 1..285: mol_type = genomic DNA

SEQ ID NO: 173 - DNA, 471 bp, Salmonella enterica; identical to SEQ ID NO: 60
  source 1..471: mol_type = genomic DNA

SEQ ID NO: 174 - DNA, 393 bp, Salmonella enterica; identical to SEQ ID NO: 54
  source 1..393: mol_type = genomic DNA

SEQ ID NO: 175 - DNA, 435 bp, Salmonella enterica; identical to SEQ ID NO: 55
  source 1..435: mol_type = genomic DNA

SEQ ID NO: 176 - DNA, 384 bp, Salmonella enterica; identical to SEQ ID NO: 56
  source 1..384: mol_type = genomic DNA

SEQ ID NO: 177 - DNA, 621 bp, Salmonella enterica; identical to SEQ ID NO: 57
  source 1..621: mol_type = genomic DNA

SEQ ID NO: 178 - DNA, 312 bp, Salmonella enterica; identical to SEQ ID NO: 58
  source 1..312: mol_type = genomic DNA

SEQ ID NO: 179 - DNA, 285 bp, Salmonella enterica; identical to SEQ ID NO: 59
  source 1..285: mol_type = genomic DNA

SEQ ID NO: 180 - DNA, 471 bp, Salmonella enterica; identical to SEQ ID NO: 60
  source 1..471: mol_type = genomic DNA

SEQ ID NO: 181 - DNA, 393 bp, Salmonella enterica; identical to SEQ ID NO: 54
  source 1..393: mol_type = genomic DNA

SEQ ID NO: 182 - DNA, 435 bp, Salmonella enterica; identical to SEQ ID NO: 55
  source 1..435: mol_type = genomic DNA

SEQ ID NO: 183 - DNA, 384 bp, Salmonella enterica; identical to SEQ ID NO: 56
  source 1..384: mol_type = genomic DNA

SEQ ID NO: 184 - DNA, 621 bp, Salmonella enterica; identical to SEQ ID NO: 57
  source 1..621: mol_type = genomic DNA

SEQ ID NO: 185 - DNA, 312 bp, Salmonella enterica; identical to SEQ ID NO: 58
  source 1..312: mol_type = genomic DNA

SEQ ID NO: 186 - DNA, 285 bp, Salmonella enterica; identical to SEQ ID NO: 59
  source 1..285: mol_type = genomic DNA

SEQ ID NO: 187 - DNA, 471 bp, Salmonella enterica; identical to SEQ ID NO: 60
  source 1..471: mol_type = genomic DNA

SEQ ID NO: 188 - DNA, 174 bp, Salmonella enterica
  source 1..174: mol_type = genomic DNA
atgaacagcgaagagttgacacataaagcagaagaggaaatcgcggcactcattagcaaaaaggtcgccgaactacggaagaaaaccgggcaagaggtttccgaaatagagttcgtgccgcgagaaacgatgaaagggcttgagggataccacgttaaaattaaactactctag

SEQ ID NO: 189 - DNA, 210 bp, Salmonella enterica; identical to SEQ ID NO: 62
  source 1..210: mol_type = genomic DNA

SEQ ID NO: 190 - DNA, 282 bp, Salmonella enterica; identical to SEQ ID NO: 63
  source 1..282: mol_type = genomic DNA

SEQ ID NO: 191 - DNA, 393 bp, Salmonella enterica; identical to SEQ ID NO: 54
  source 1..393: mol_type = genomic DNA

SEQ ID NO: 192 - DNA, 435 bp, Salmonella enterica; identical to SEQ ID NO: 55
  source 1..435: mol_type = genomic DNA

SEQ ID NO: 193 - DNA, 384 bp, Salmonella enterica; identical to SEQ ID NO: 56
  source 1..384: mol_type = genomic DNA

SEQ ID NO: 194 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgacctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggctttccgatcctgggtctggacgtgtgggaacacgcttactatctgaaattccaaaaccgccgcccggactacatcaaagagttctggaacgtggtgaactgggacgaagcagcagcgcgtttcgccgctaaaaaataa

SEQ ID NO: 195 - DNA, 312 bp, Salmonella enterica
  source 1..312: mol_type = genomic DNA
atgtacgcggttttccaaagtggtggtaaacaacaccgagtaagcgaaggtcagaccgttcgcctggaaaagctggacatcgcaactggcgaaactatcgagttcgctgaagttctgatggtcgcaaacggtgaagaagtcaaaatcggcgttcctttcgttgatggcggcgtaatcaaagctgaagttgttgcccacggtcgtggcgagaaagttaaaatcgttaagtttcgtcgccgtaaacactaccgtaagcagcagggccatcgtcagtggttcactgatgtgaaaattaccggcatcagcgcttaa

SEQ ID NO: 196 - DNA, 285 bp, Salmonella enterica
  source 1..285: mol_type = genomic DNA
atgtttactatcaacgcagaagtacgtaaagagcagggtaagggtgcgagccgccgcctgcgcgccgctaacaagttcccggcaatcatctacggcggttctgaagccccgattgctatcgaactggaccacgaccaggtgatgaacatgcaagctaaagctgaattctacagcgaagttctgaccctcgttgttgacggtaaagaagtaaaagttaaagctcaggctgtacagcgtcacgcttacaaaccgaagctgactcatatcgacttcgttcgcgcgtaa

SEQ ID NO: 197 - DNA, 471 bp, Salmonella enterica; identical to SEQ ID NO: 60
  source 1..471: mol_type = genomic DNA

SEQ ID NO: 198 - DNA, 174 bp, Salmonella enterica; identical to SEQ ID NO: 61
  source 1..174: mol_type = genomic DNA

SEQ ID NO: 199 - DNA, 210 bp, Salmonella enterica; identical to SEQ ID NO: 62
  source 1..210: mol_type = genomic DNA

SEQ ID NO: 200 - DNA, 282 bp, Salmonella enterica
  source 1..282: mol_type = genomic DNA
atggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatacccagttcggttaccacatcattaaagtattgtatcgcaaataa

SEQ ID NO: 201 - DNA, 393 bp, Salmonella enterica; identical to SEQ ID NO: 54
  source 1..393: mol_type = genomic DNA

SEQ ID NO: 202 - DNA, 435 bp, Salmonella enterica; identical to SEQ ID NO: 55
  source 1..435: mol_type = genomic DNA

SEQ ID NO: 203 - DNA, 384 bp, Salmonella enterica; identical to SEQ ID NO: 56
  source 1..384: mol_type = genomic DNA

SEQ ID NO: 204 - DNA, 621 bp, Salmonella enterica; identical to SEQ ID NO: 194
  source 1..621: mol_type = genomic DNA

SEQ ID NO: 205 - DNA, 312 bp, Salmonella enterica; identical to SEQ ID NO: 195
  source 1..312: mol_type = genomic DNA

SEQ ID NO: 206 - DNA, 285 bp, Salmonella enterica; identical to SEQ ID NO: 196
  source 1..285: mol_type = genomic DNA

SEQ ID NO: 207 - DNA, 471 bp, Salmonella enterica; identical to SEQ ID NO: 60
  source 1..471: mol_type = genomic DNA

SEQ ID NO: 208 - DNA, 393 bp, Salmonella enterica; identical to SEQ ID NO: 54
  source 1..393: mol_type = genomic DNA

SEQ ID NO: 209 - DNA, 435 bp, Salmonella enterica; identical to SEQ ID NO: 55
  source 1..435: mol_type = genomic DNA

SEQ ID NO: 210 - DNA, 384 bp, Salmonella enterica; identical to SEQ ID NO: 56
  source 1..384: mol_type = genomic DNA

SEQ ID NO: 211 - DNA, 621 bp, Salmonella enterica; identical to SEQ ID NO: 194
  source 1..621: mol_type = genomic DNA

SEQ ID NO: 212 - DNA, 312 bp, Salmonella enterica; identical to SEQ ID NO: 195
  source 1..312: mol_type = genomic DNA

SEQ ID NO: 213 - DNA, 285 bp, Salmonella enterica; identical to SEQ ID NO: 196
  source 1..285: mol_type = genomic DNA

SEQ ID NO: 214 - DNA, 471 bp, Salmonella enterica; identical to SEQ ID NO: 60
  source 1..471: mol_type = genomic DNA

SEQ ID NO: 215 - DNA, 393 bp, Salmonella enterica; identical to SEQ ID NO: 54
  source 1..393: mol_type = genomic DNA

SEQ ID NO: 216 - DNA, 435 bp, Salmonella enterica; identical to SEQ ID NO: 55
  source 1..435: mol_type = genomic DNA

SEQ ID NO: 217 - DNA, 384 bp, Salmonella enterica; identical to SEQ ID NO: 56
  source 1..384: mol_type = genomic DNA

SEQ ID NO: 218 - DNA, 621 bp, Salmonella enterica; identical to SEQ ID NO: 194
  source 1..621: mol_type = genomic DNA

SEQ ID NO: 219 - DNA, 312 bp, Salmonella enterica; identical to SEQ ID NO: 195
  source 1..312: mol_type = genomic DNA

SEQ ID NO: 220 - DNA, 285 bp, Salmonella enterica; identical to SEQ ID NO: 196
  source 1..285: mol_type = genomic DNA

SEQ ID NO: 221 - DNA, 471 bp, Salmonella enterica; identical to SEQ ID NO: 60
  source 1..471: mol_type = genomic DNA

SEQ ID NO: 222 - DNA, 393 bp, Salmonella enterica; identical to SEQ ID NO: 54
  source 1..393: mol_type = genomic DNA

SEQ ID NO: 223 - DNA, 435 bp, Salmonella enterica; identical to SEQ ID NO: 55
  source 1..435: mol_type = genomic DNA

SEQ ID NO: 224 - DNA, 384 bp, Salmonella enterica; identical to SEQ ID NO: 56
  source 1..384: mol_type = genomic DNA

SEQ ID NO: 225 - DNA, 621 bp, Salmonella enterica; identical to SEQ ID NO: 194
  source 1..621: mol_type = genomic DNA

SEQ ID NO: 226 - DNA, 312 bp, Salmonella enterica; identical to SEQ ID NO: 195
  source 1..312: mol_type = genomic DNA

SEQ ID NO: 227 - DNA, 285 bp, Salmonella enterica; identical to SEQ ID NO: 59
  source 1..285: mol_type = genomic DNA

SEQ ID NO: 228 - DNA, 471 bp, Salmonella enterica; identical to SEQ ID NO: 60
  source 1..471: mol_type = genomic DNA

SEQ ID NO: 229 - DNA, 393 bp, Salmonella enterica; identical to SEQ ID NO: 54
  source 1..393: mol_type = genomic DNA

SEQ ID NO: 230 - DNA, 435 bp, Salmonella enterica; identical to SEQ ID NO: 55
  source 1..435: mol_type = genomic DNA

SEQ ID NO: 231 - DNA, 384 bp, Salmonella enterica; identical to SEQ ID NO: 56
  source 1..384: mol_type = genomic DNA

SEQ ID NO: 232 - DNA, 621 bp, Salmonella enterica; identical to SEQ ID NO: 194
  source 1..621: mol_type = genomic DNA

SEQ ID NO: 233 - DNA, 312 bp, Salmonella enterica; identical to SEQ ID NO: 195
  source 1..312: mol_type = genomic DNA

SEQ ID NO: 234 - DNA, 285 bp, Salmonella enterica; identical to SEQ ID NO: 196
  source 1..285: mol_type = genomic DNA

SEQ ID NO: 235 - DNA, 471 bp, Salmonella enterica; identical to SEQ ID NO: 60
  source 1..471: mol_type = genomic DNA

SEQ ID NO: 236 - DNA, 393 bp, Salmonella enterica; identical to SEQ ID NO: 54
  source 1..393: mol_type = genomic DNA

SEQ ID NO: 237 - DNA, 435 bp, Salmonella enterica; identical to SEQ ID NO: 55
  source 1..435: mol_type = genomic DNA

SEQ ID NO: 238 - DNA, 384 bp, Salmonella enterica; identical to SEQ ID NO: 56
  source 1..384: mol_type = genomic DNA

SEQ ID NO: 239 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggatcaggtgccagcggacaaaaaaaccgtgctgcgtaacaacgctggcggccatgctaaccacagcttcttctggaagggcctgaaaaaaggcaccaccctgcagggtgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactatctgaaattccagaaccgccgcccggactacatcaaagagttctggaacgtggtgaactgggacgaagcagcagcgcgtttcgccgctaaaaaataa

SEQ ID NO: 240 - DNA, 312 bp, Salmonella enterica; identical to SEQ ID NO: 58
  source 1..312: mol_type = genomic DNA

SEQ ID NO: 241 - DNA, 285 bp, Salmonella enterica; identical to SEQ ID NO: 59
  source 1..285: mol_type = genomic DNA

SEQ ID NO: 242 - DNA, 471 bp, Salmonella enterica
  source 1..471: mol_type = genomic DNA
atgccacgtcgtcgcgtcattggtcagcgtaaaattctgccggatccgaagttcggatcagaactgctggctaaatttgtcaatatcctgatggtagatggtaaaaaatctactgcagaatcaatcgtatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaaacgcggtgataaatccatggctctgcgcctggcgaacgaactttctgacgctgcagacaacaaaggtactgcagttaagaaacgtgaagacgttcaccgtatggcagaagccaacaaggcgttcgcacactaccgttggtaa

SEQ ID NO: 243 - DNA, 174 bp, Salmonella enterica; identical to SEQ ID NO: 61
  source 1..174: mol_type = genomic DNA

SEQ ID NO: 244 - DNA, 210 bp, Salmonella enterica
  source 1..210: mol_type = genomic DNA
atggcaaaaataggtgagaacgtaccacttcttattgataaagccgtcgattttatggcgtccagccaggcgttccgtgagtacttgaataaaacgccgccgcgtgattatgttccttccgaagtgccgtcggagagcgcgcccatttatttgcagcgtctggaatattaccggcggctgtaccgaccaaaagaagaagaaagaggttaa

SEQ ID NO: 245 - DNA, 282 bp, Salmonella enterica
  source 1..282: mol_type = genomic DNA
atggcaaaaatggcagcagcactgcatatccttgtaaaagaagagaaactggcattggatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccattgcacacccagttcggttatcacatcattaaggtattgtatcgcaaataa

SEQ ID NO: 246 - DNA, 393 bp, Salmonella enterica; identical to SEQ ID NO: 54
  source 1..393: mol_type = genomic DNA

SEQ ID NO: 247 - DNA, 435 bp, Salmonella enterica; identical to SEQ ID NO: 55
  source 1..435: mol_type = genomic DNA

SEQ ID NO: 248 - DNA, 384 bp, Salmonella enterica; identical to SEQ ID NO: 56
  source 1..384: mol_type = genomic DNA

SEQ ID NO: 249 - DNA, 621 bp, Salmonella enterica
  source 1..621: mol_type = genomic DNA
atgagttatacactgccatccctgccgtacgcttatgatgcactggaaccgcacttcgataagcagacgatggcgattcaccacaccaaacaccatcaaacctatgtcaacaacgctaacgcggcgctggaaaacctgcctgagtttgctgacctgccggttgaagaactgattactaaactggatcaggtgccagcggacaaaaaaaccgtactgcgtaacaacgcgggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggcctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 250 - DNA, 312 bp, Salmonella enterica; identical to SEQ ID NO: 58
  source 1..312: mol_type = genomic DNA

SEQ ID NO: 251 - DNA, 285 bp, Salmonella enterica; identical to SEQ ID NO: 59
  source 1..285: mol_type = genomic DNA

SEQ ID NO: 252 - DNA, 471 bp, Salmonella enterica
  source 1..471: mol_type = genomic DNA
atgccacgtcgtcgcgtcattggtcagcgtaaaattctgccggatccgaagttcggatcagaactgctggctaaatttgtcaatatcctgatggtagatggtaaaaaatctactgcagaatcaatcgcatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaaacgcggtgataaatccatggctctgcgcctggcgaacgaactttctgacgctgcagacaacaaaggtactgcagttaagaaacgtgaagacgttcaccgtatggcagaagccaacaaggcgttcgcacactaccgttggtaa

SEQ ID NO: 253 - DNA, 174 bp, Salmonella enterica; identical to SEQ ID NO: 61
  source 1..174: mol_type = genomic DNA

SEQ ID NO: 254 - DNA, 210 bp, Salmonella enterica; identical to SEQ ID NO: 62
  source 1..210: mol_type = genomic DNA

SEQ ID NO: 255 - DNA, 282 bp, Salmonella enterica
  source 1..282: mol_type = genomic DNA
atggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccattgcacacccagttcggttatcacatcattaaggtattgtatcgcaaataa

SEQ ID NO: 256 - DNA, 393 bp, Salmonella enterica; identical to SEQ ID NO: 54
  source 1..393: mol_type = genomic DNA

SEQ ID NO: 257 - DNA, 435 bp, Salmonella enterica
  source 1..435: mol_type = genomic DNA
atgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgcaaagcagcgattacagccgaagttcgtctgtctgacctggcgaaagtagaaggcggcgttgtagacctgaacacgctgaaagcggcaaacattatcggtatccagatcgagttcgcgaaagtgatcctggctggcgaagtcactactccggtaactattcgtggcctgcgtgttactaaaggcgctcgtgctgctatcgaagctgctggcggtaaaatcgaggaataa

SEQ ID NO: 258 - DNA, 384 bp, Salmonella enterica; identical to SEQ ID NO: 56
  source 1..384: mol_type = genomic DNA

SEQ ID NO: 259 - DNA, 621 bp, Salmonella enterica; identical to SEQ ID NO: 57
  source 1..621: mol_type = genomic DNA

SEQ ID NO: 260 - DNA, 312 bp, Salmonella enterica; identical to SEQ ID NO: 58
  source 1..312: mol_type = genomic DNA

SEQ ID NO: 261 - DNA, 285 bp, Salmonella enterica; identical to SEQ ID NO: 59
  source 1..285: mol_type = genomic DNA

SEQ ID NO: 262 - DNA, 174 bp, Salmonella enterica; identical to SEQ ID NO: 61
  source 1..174: mol_type = genomic DNA

SEQ ID NO: 263 - DNA, 210 bp, Salmonella enterica; identical to SEQ ID NO: 62
  source 1..210: mol_type = genomic DNA

SEQ ID NO: 264 - DNA, 282 bp, Salmonella enterica; identical to SEQ ID NO: 63
  source 1..282: mol_type = genomic DNA

SEQ ID NO: 265 - DNA, 393 bp, Salmonella enterica; identical to SEQ ID NO: 54
  source 1..393: mol_type = genomic DNA

SEQ ID NO: 266 - DNA, 435 bp, Salmonella enterica; identical to SEQ ID NO: 55
  source 1..435: mol_type = genomic DNA

SEQ ID NO: 267 - DNA, 384 bp, Salmonella enterica; identical to SEQ ID NO: 56
  source 1..384: mol_type = genomic DNA

SEQ ID NO: 268 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggatcaggtgccagcggacaaaaaaaccgtgctgcgtaacaacgcgggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtttgggaacacgcttactacctgaaattccagaaccgccgcccggactacatcaaagagttctggaacgtggtgaactgggacgaagcagcagcgcgtttcgccgctaaaaaataa

SEQ ID NO: 269 - DNA, 312 bp, Salmonella enterica; identical to SEQ ID NO: 58
  source 1..312: mol_type = genomic DNA

SEQ ID NO: 270 - DNA, 285 bp, Salmonella enterica; identical to SEQ ID NO: 59
  source 1..285: mol_type = genomic DNA

SEQ ID NO: 271 - DNA, 471 bp, Salmonella enterica; identical to SEQ ID NO: 242
  source 1..471: mol_type = genomic DNA

SEQ ID NO: 272 - DNA, 393 bp, Salmonella enterica; identical to SEQ ID NO: 54
  source 1..393: mol_type = genomic DNA

SEQ ID NO: 273 - DNA, 435 bp, Salmonella enterica; identical to SEQ ID NO: 55
  source 1..435: mol_type = genomic DNA

SEQ ID NO: 274 - DNA, 384 bp, Salmonella enterica; identical to SEQ ID NO: 56
  source 1..384: mol_type = genomic DNA

SEQ ID NO: 275 - DNA, 621 bp, Salmonella enterica; identical to SEQ ID NO: 194
  source 1..621: mol_type = genomic DNA

SEQ ID NO: 276 - DNA, 312 bp, Salmonella enterica; identical to SEQ ID NO: 195
  source 1..312: mol_type = genomic DNA

SEQ ID NO: 277 - DNA, 285 bp, Salmonella enterica; identical to SEQ ID NO: 59
  source 1..285: mol_type = genomic DNA

SEQ ID NO: 278 - DNA, 471 bp, Salmonella enterica; identical to SEQ ID NO: 60
  source 1..471: mol_type = genomic DNA

SEQ ID NO: 279 - DNA, 393 bp, Salmonella enterica; identical to SEQ ID NO: 54
  source 1..393: mol_type = genomic DNA

SEQ ID NO: 280 - DNA, 435 bp, Salmonella enterica; identical to SEQ ID NO: 67
  source 1..435: mol_type = genomic DNA

SEQ ID NO: 281 - DNA, 384 bp, Salmonella enterica; identical to SEQ ID NO: 56
  source 1..384: mol_type = genomic DNA

SEQ ID NO: 282 - DNA, 621 bp, Salmonella enterica; identical to SEQ ID NO: 69
  source 1..621: mol_type = genomic DNA

SEQ ID NO: 283 - DNA, 312 bp, Salmonella enterica; identical to SEQ ID NO: 58
  source 1..312: mol_type = genomic DNA

SEQ ID NO: 284 - DNA, 285 bp, Salmonella enterica; identical to SEQ ID NO: 59
  source 1..285: mol_type = genomic DNA

SEQ ID NO: 285 - DNA, 471 bp, Salmonella enterica; identical to SEQ ID NO: 72
  source 1..471: mol_type = genomic DNA

SEQ ID NO: 286 - DNA, 393 bp, Salmonella enterica; identical to SEQ ID NO: 54
  source 1..393: mol_type = genomic DNA

SEQ ID NO: 287 - DNA, 435 bp, Salmonella enterica; identical to SEQ ID NO: 55
  source 1..435: mol_type = genomic DNA

SEQ ID NO: 288 - DNA, 384 bp, Salmonella enterica; identical to SEQ ID NO: 56
  source 1..384: mol_type = genomic DNA

SEQ ID NO: 289 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccgtttccggcgcttccggcttcccgatcctgggcctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 290 - DNA, 312 bp, Salmonella enterica; identical to SEQ ID NO: 58
  source 1..312: mol_type = genomic DNA

SEQ ID NO: 291 - DNA, 285 bp, Salmonella enterica
  source 1..285: mol_type = genomic DNA
atgtttactatcaacgcagaagtacgtaaagagcagggtaagggtgcgagccgccgcctgcgcgccgctaacaagttcccggcaatcatctacggcggttctgaagccccggttgctatcgaactggaccacgaccaggtgatgaacatgcaagctaaagctgaattctacagcgaagttctgaccctcgtggttgacggtaaagaagtaaaagttaaagctcaggctgtacagcgtcacgcttacaaaccgaagctgactcacatcgacttcgttcgcgcgtaa

SEQ ID NO: 292 - DNA, 471 bp, Salmonella enterica
  source 1..471: mol_type = genomic DNA
atgccacgtcgtcgcgtcattggtcagcgtaaaattctgccggatccgaagttcggatcagaactgctggctaaatttgtcaatatcctgatggtagatggtaaaaaatctactgcagaatcaatcgtatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaaacgcggtgataaatccatggctctgcgcctggcgaacgaactttctgacgctgcagaaaacaaaggtactgcagttaagaaacgtgaagacgttcaccgtatggcagaagccaacaaggcgttcgcacactaccgttggtaa

SEQ ID NO: 293 - DNA, 393 bp, Salmonella enterica; identical to SEQ ID NO: 54
  source 1..393: mol_type = genomic DNA

SEQ ID NO: 294 - DNA, 435 bp, Salmonella enterica; identical to SEQ ID NO: 55
  source 1..435: mol_type = genomic DNA

SEQ ID NO: 295 - DNA, 384 bp, Salmonella enterica; identical to SEQ ID NO: 56
  source 1..384: mol_type = genomic DNA

SEQ ID NO: 296 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacttgccagagtttgctgacctgccggttgaagaactgattactaaactggaccaggtgccagcggacaaaaaaaccgtgctgcgtaacaacgcgggcggccacgctaaccacagcttcttctggaaaggcctgaaaaaaggctccaccctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 297 - DNA, 312 bp, Salmonella enterica; identical to SEQ ID NO: 58
  source 1..312: mol_type = genomic DNA

SEQ ID NO: 298 - DNA, 285 bp, Salmonella enterica; identical to SEQ ID NO: 59
  source 1..285: mol_type = genomic DNA

SEQ ID NO: 299 - DNA, 471 bp, Salmonella enterica; identical to SEQ ID NO: 242
  source 1..471: mol_type = genomic DNA

SEQ ID NO: 300 - DNA, 393 bp, Salmonella enterica; identical to SEQ ID NO: 54
  source 1..393: mol_type = genomic DNA

SEQ ID NO: 301 - DNA, 435 bp, Salmonella enterica; identical to SEQ ID NO: 55
  source 1..435: mol_type = genomic DNA

SEQ ID NO: 302 - DNA, 384 bp, Salmonella enterica; identical to SEQ ID NO: 56
  source 1..384: mol_type = genomic DNA

SEQ ID NO: 303 - DNA, 621 bp, Salmonella enterica; identical to SEQ ID NO: 57
  source 1..621: mol_type = genomic DNA

SEQ ID NO: 304 - DNA, 312 bp, Salmonella enterica; identical to SEQ ID NO: 58
  source 1..312: mol_type = genomic DNA

SEQ ID NO: 305 - DNA, 285 bp, Salmonella enterica; identical to SEQ ID NO: 59
  source 1..285: mol_type = genomic DNA

SEQ ID NO: 306 - DNA, 471 bp, Salmonella enterica; identical to SEQ ID NO: 60
  source 1..471: mol_type = genomic DNA

SEQ ID NO: 307 - DNA, 393 bp, Salmonella enterica; identical to SEQ ID NO: 54
  source 1..393: mol_type = genomic DNA

SEQ ID NO: 308 - DNA, 435 bp, Salmonella enterica; identical to SEQ ID NO: 55
  source 1..435: mol_type = genomic DNA

SEQ ID NO: 309 - DNA, 384 bp, Salmonella enterica; identical to SEQ ID NO: 56
  source 1..384: mol_type = genomic DNA

SEQ ID NO: 310 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgacctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 311 - DNA, 312 bp, Salmonella enterica; identical to SEQ ID NO: 195
  source 1..312: mol_type = genomic DNA

SEQ ID NO: 312 - DNA, 285 bp, Salmonella enterica; identical to SEQ ID NO: 59
  source 1..285: mol_type = genomic DNA

SEQ ID NO: 313 - DNA, 471 bp, Salmonella enterica; identical to SEQ ID NO: 242
  source 1..471: mol_type = genomic DNA

SEQ ID NO: 314 - DNA, 174 bp, Salmonella enterica; identical to SEQ ID NO: 61
  source 1..174: mol_type = genomic DNA

SEQ ID NO: 315 - DNA, 210 bp, Salmonella enterica; identical to SEQ ID NO: 62
  source 1..210: mol_type = genomic DNA

SEQ ID NO: 316 - DNA, 282 bp, Salmonella enterica; identical to SEQ ID NO: 200
  source 1..282: mol_type = genomic DNA

SEQ ID NO: 317 - DNA, 504 bp, Salmonella enterica
  source 1..504: mol_type = genomic DNA
atgaatattaaaaccgttgaagacctttttatccatctactttcagatacctatagtgcagaaaaacaattaaccaaggctctttctaaactagccagagccacgtccaatgaaaaattaagccaggcctttcaatctcatcttgaagaaacccagggtcagattgaacgtattgatcagatcgtcgaatctgaatctggcattaaactgaaaagaatgaaatgcgtcgctatggaagggctgattgaagaagccaatgaagtcatcgaaagtacggagaaaaacgaagtacgcgatgcagcgcttatcgccgcggcgcaaaaagtcgagcattacgaaatcgccagctacggcacgcttgccaccctggccgagcagctcggctatagcaaagcattaaaactgctcaaagaaaccctcgacgaggaaaaacaaactgatttaaaacttaccgatttagcagtcagcaatgttaataaaagtgctgaacgcaaatcgaaataa

SEQ ID NO: 318 - DNA, 393 bp, Salmonella enterica; identical to SEQ ID NO: 54
  source 1..393: mol_type = genomic DNA

SEQ ID NO: 319 - DNA, 435 bp, Salmonella enterica; identical to SEQ ID NO: 55
  source 1..435: mol_type = genomic DNA

SEQ ID NO: 320 - DNA, 384 bp, Salmonella enterica
  source 1..384: mol_type = genomic DNA
atgcgccatcgtaagagtggtcgtcaactgaaccgcaacagcagccatcgccaggctatgttccgcaatatggcaggttcactggttcgtcatgaaatcatcaagacgaccctgcctaaagcgaaagagctgcgtcgcgtagttgagccgctgattactcttgccaagactgatagcgttgctaatcgtcgtctggcattcgcccgtactcgtgataacgagatcgtggcaaaactgtttaacgagctgggcccgcgtttcgcgagccgcgccggtggttacactcgcattctgaagtgtggcttccgtgcaggcgacaacgcgccgatggcatacatcgagctggttgatcgttcagagaaaacagaagctgctgcagagtaa

SEQ ID NO: 321 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggatcaggtgccagcggacaaaaaaaccgtgctgcgtaacaacgcgggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactatctgaaattccagaaccgccgcccggactacatcaaagagttctggaacgtggtgaactgggacgaagcagcagcgcgtttcgccgctaaaaaataa

SEQ ID NO: 322 - DNA, 312 bp, Salmonella enterica; identical to SEQ ID NO: 58
  source 1..312: mol_type = genomic DNA

SEQ ID NO: 323 - DNA, 285 bp, Salmonella enterica; identical to SEQ ID NO: 59
  source 1..285: mol_type = genomic DNA

SEQ ID NO: 324 - DNA, 471 bp, Salmonella enterica; identical to SEQ ID NO: 292
  source 1..471: mol_type = genomic DNA

SEQ ID NO: 325 - DNA, 174 bp, Salmonella enterica; identical to SEQ ID NO: 61
  source 1..174: mol_type = genomic DNA

SEQ ID NO: 326 - DNA, 210 bp, Salmonella enterica
  source 1..210: mol_type = genomic DNA
atggcaaaaataggtgagaacgtaccacttcttattgataaagccgtcgattttatggcgtccagccaggcgttccgtgaatacctgaataaaacgccgccgcgtgattatgttccttccgaggtgccgtcggagagcgcgcccatttatttgcagcgtctggaatattaccggcggctgtaccgaccaaaagaagaagaaaggagttaa

SEQ ID NO: 327 - DNA, 282 bp, Salmonella enterica
  source 1..282: mol_type = genomic DNA
atggcaaaaatggcagcagcactgcatatccttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatacccagttcggttaccacatcattaaggtattgtatcgtaaataa

SEQ ID NO: 328 - DNA, 393 bp, Salmonella enterica; identical to SEQ ID NO: 54
  source 1..393: mol_type = genomic DNA

SEQ ID NO: 329 - DNA, 435 bp, Salmonella enterica
  source 1..435: mol_type = genomic DNA
atgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgtggtttcgagggtggtcagatgcctctgtaccgtcgtctgccgaaattcggcttcacttctcgcaaagcagcgattacagccgaagttcgtctgtctgacctggcgaaagtagaaggcggcgttgtagacctgaacacgctgaaagcggcaaacattatcggtatccagatcgagttcgcgaaagtgatcctggctggcgaagtcactactccggtaactgttcgtggcctgcgtgttactaaaggcgctcgtgctgctatcgaagctgctggcggtaaaatcgaggaataa

SEQ ID NO: 330 - DNA, 384 bp, Salmonella enterica; identical to SEQ ID NO: 56
  source 1..384: mol_type = genomic DNA

SEQ ID NO: 331 - DNA, 621 bp, Salmonella enterica; identical to SEQ ID NO: 57
  source 1..621: mol_type = genomic DNA

SEQ ID NO: 332 - DNA, 312 bp, Salmonella enterica; identical to SEQ ID NO: 58
  source 1..312: mol_type = genomic DNA

SEQ ID NO: 333 - DNA, 285 bp, Salmonella enterica; identical to SEQ ID NO: 59
  source 1..285: mol_type = genomic DNA

SEQ ID NO: 334 - DNA, 471 bp, Salmonella enterica; identical to SEQ ID NO: 60
  source 1..471: mol_type = genomic DNA

SEQ ID NO: 335 - DNA, 174 bp, Salmonella enterica; identical to SEQ ID NO: 61
  source 1..174: mol_type = genomic DNA

SEQ ID NO: 336 - DNA, 210 bp, Salmonella enterica
  source 1..210: mol_type = genomic DNA
atggcaaaaataggtgagaacgtaccacttcttattgataaagccgtcgattttatggcgtccagccaggcgttccgtgaatacctgaataaaacgccgccgcgtgattatgttccttccgaagtgccgtcggagagcgcgcccatttatttgcagcgtctggcatattaccgacggttgtaccgaccaaaagaagaagaaagaggttaa

SEQ ID NO: 337 - DNA, 282 bp, Salmonella enterica; identical to SEQ ID NO: 327
  source 1..282: mol_type = genomic DNA

SEQ ID NO: 338 - DNA, 192 bp, Salmonella enterica; identical to SEQ ID NO: 73
  source 1..192: mol_type = genomic DNA

SEQ ID NO: 339 - DNA, 393 bp, Salmonella enterica; identical to SEQ ID NO: 54
  source 1..393: mol_type = genomic DNA

SEQ ID NO: 340 - DNA, 435 bp, Salmonella enterica; identical to SEQ ID NO: 55
  source 1..435: mol_type = genomic DNA

SEQ ID NO: 341 - DNA, 384 bp, Salmonella enterica; identical to SEQ ID NO: 56
  source 1..384: mol_type = genomic DNA

SEQ ID NO: 342 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaaggactgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggtgcttccggcttcccgatcctgggtctggacgtgtgggaacacgcttactatctgaaattccagaaccgccgcccggactacatcaaagagttctggaacgtggtgaactgggacgaagcagcagcgcgtttcgccgctaaaaaataa

SEQ ID NO: 343 - DNA, 312 bp, Salmonella enterica; identical to SEQ ID NO: 58
  source 1..312: mol_type = genomic DNA

SEQ ID NO: 344 - DNA, 285 bp, Salmonella enterica; identical to SEQ ID NO: 59
  source 1..285: mol_type = genomic DNA

SEQ ID NO: 345 - DNA, 471 bp, Salmonella enterica; identical to SEQ ID NO: 242
  source 1..471: mol_type = genomic DNA

SEQ ID NO: 346 - DNA, 174 bp, Salmonella enterica
  source 1..174: mol_type = genomic DNA
atgaacagcgaagagttgacacataaagcagaagaggaaatcgcggcactcattagcaaaaaggttgccgaactacggaagaaaaccgggcaagaggtttccgaaatagagttcgtgccgcgagaaacgatgaaagggcttgagggataccacgttaaaattaaactactctag

SEQ ID NO: 347 - DNA, 210 bp, Salmonella enterica; identical to SEQ ID NO: 62
  source 1..210: mol_type = genomic DNA

SEQ ID NO: 348 - DNA, 282 bp, Salmonella enterica
  source 1..282: mol_type = genomic DNA
atggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatactcagttcggttaccacatcattaaagtattgtatcgcaaataa

SEQ ID NO: 349 - DNA, 393 bp, Salmonella enterica; identical to SEQ ID NO: 54
  source 1..393: mol_type = genomic DNA

SEQ ID NO: 350 - DNA, 435 bp, Salmonella enterica; identical to SEQ ID NO: 55
  source 1..435: mol_type = genomic DNA

SEQ ID NO: 351 - DNA, 384 bp, Salmonella enterica; identical to SEQ ID NO: 56
  source 1..384: mol_type = genomic DNA

SEQ ID NO: 352 - DNA, 621 bp, Salmonella enterica; identical to SEQ ID NO: 310
  source 1..621: mol_type = genomic DNA

SEQ ID NO: 353 - DNA, 312 bp, Salmonella enterica; identical to SEQ ID NO: 195
  source 1..312: mol_type = genomic DNA

SEQ ID NO: 354 - DNA, 285 bp, Salmonella enterica; identical to SEQ ID NO: 59
  source 1..285: mol_type = genomic DNA

SEQ ID NO: 355 - DNA, 471 bp, Salmonella enterica; identical to SEQ ID NO: 242
  source 1..471: mol_type = genomic DNA

SEQ ID NO: 356 - DNA, 393 bp, Salmonella enterica; identical to SEQ ID NO: 54
  source 1..393: mol_type = genomic DNA

SEQ ID NO: 357 - DNA, 435 bp, Salmonella enterica; identical to SEQ ID NO: 55
  source 1..435: mol_type = genomic DNA

SEQ ID NO: 358 - DNA, 384 bp, Salmonella enterica; identical to SEQ ID NO: 56
  source 1..384: mol_type = genomic DNA

SEQ ID NO: 359 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactatctgaaattccagaaccgccgcccggactacatcaaagagttctggaacgtggtgaactgggacgaagcagcagcgcgtttcgccgctaaaaaataa

SEQ ID NO: 360 - DNA, 312 bp, Salmonella enterica; identical to SEQ ID NO: 58
  source 1..312: mol_type = genomic DNA

SEQ ID NO: 361 - DNA, 285 bp, Salmonella enterica; identical to SEQ ID NO: 59
  source 1..285: mol_type = genomic DNA

SEQ ID NO: 362 - DNA, 471 bp, Salmonella enterica; identical to SEQ ID NO: 242
  source 1..471: mol_type = genomic DNA

SEQ ID NO: 363 - DNA, 174 bp, Salmonella enterica; identical to SEQ ID NO: 346
  source 1..174: mol_type = genomic DNA

SEQ ID NO: 364 - DNA, 210 bp, Salmonella enterica; identical to SEQ ID NO: 62
  source 1..210: mol_type = genomic DNA

SEQ ID NO: 365 - DNA, 282 bp, Salmonella enterica; identical to SEQ ID NO: 348
  source 1..282: mol_type = genomic DNA

SEQ ID NO: 366 - DNA, 393 bp, Salmonella enterica; identical to SEQ ID NO: 54
  source 1..393: mol_type = genomic DNA

SEQ ID NO: 367 - DNA, 435 bp, Salmonella enterica; identical to SEQ ID NO: 55
  source 1..435: mol_type = genomic DNA

SEQ ID NO: 368 - DNA, 384 bp, Salmonella enterica; identical to SEQ ID NO: 56
  source 1..384: mol_type = genomic DNA

SEQ ID NO: 369 - DNA, 621 bp, Salmonella enterica; identical to SEQ ID NO: 310
  source 1..621: mol_type = genomic DNA

SEQ ID NO: 370 - DNA, 312 bp, Salmonella enterica; identical to SEQ ID NO: 195
  source 1..312: mol_type = genomic DNA

SEQ ID NO: 371 - DNA, 285 bp, Salmonella enterica; identical to SEQ ID NO: 59
  source 1..285: mol_type = genomic DNA

SEQ ID NO: 372 - DNA, 471 bp, Salmonella enterica; identical to SEQ ID NO: 242
  source 1..471: mol_type = genomic DNA

SEQ ID NO: 373 - DNA, 393 bp, Salmonella enterica
  source 1..393: mol_type = genomic DNA
atgagcatgcaagatccgatcgcggatatgctgacccgtatccgtaacggtcaggccgcgaacaaagctgcggtcaccatgccttcctccaagctgaaagtggcaattgccaacgtgctgaaggaagaaggttttattgaagattttaaagttgaaggcgacaccaagccggaactggaactgattcttaagtatttccagggtaaagctgttgtagaaagcattcagcgtgtcagccgcccaggtctgcgcatctacaaacgtaaagatgagctgccgaaagttatggccggtctgggtatcgcagttgtttctacctctaaaggtgttatgactgatcgtgcagcgcgccaggctggtcttggtggcgaaattatctgctacgtagcctaa

SEQ ID NO: 374 - DNA, 435 bp, Salmonella enterica; identical to SEQ ID NO: 55
  source 1..435: mol_type = genomic DNA

SEQ ID NO: 375 - DNA, 384 bp, Salmonella enterica; identical to SEQ ID NO: 56
  source 1..384: mol_type = genomic DNA

SEQ ID NO: 376 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgatctgaaagtggctatcgagcgtgacttcggttccgttgacaacttcaaagctgaattcgaaaaagcagcagcaacccgtttcggctccggctgggcgtggctggtgctgaaaggtgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 377 - DNA, 312 bp, Salmonella enterica; identical to SEQ ID NO: 58
  source 1..312: mol_type = genomic DNA

SEQ ID NO: 378 - DNA, 285 bp, Salmonella enterica; identical to SEQ ID NO: 59
  source 1..285: mol_type = genomic DNA

SEQ ID NO: 379 - DNA, 471 bp, Salmonella enterica; identical to SEQ ID NO: 292
  source 1..471: mol_type = genomic DNA

SEQ ID NO: 380 - DNA, 393 bp, Salmonella enterica; identical to SEQ ID NO: 54
  source 1..393: mol_type = genomic DNA

SEQ ID NO: 381 - DNA, 435 bp, Salmonella enterica; identical to SEQ ID NO: 55
  source 1..435: mol_type = genomic DNA

SEQ ID NO: 382 - DNA, 384 bp, Salmonella enterica; identical to SEQ ID NO: 56
  source 1..384: mol_type = genomic DNA

SEQ ID NO: 383 - DNA, 621 bp, Salmonella enterica; identical to SEQ ID NO: 57
  source 1..621: mol_type = genomic DNA

SEQ ID NO: 384 - DNA, 312 bp, Salmonella enterica; identical to SEQ ID NO: 58
  source 1..312: mol_type = genomic DNA

SEQ ID NO: 385 - DNA, 285 bp, Salmonella enterica; identical to SEQ ID NO: 59
  source 1..285: mol_type = genomic DNA

SEQ ID NO: 386 - DNA, 471 bp, Salmonella enterica; identical to SEQ ID NO: 60
  source 1..471: mol_type = genomic DNA

SEQ ID NO: 387 - DNA, 174 bp, Salmonella enterica; identical to SEQ ID NO: 61
  source 1..174: mol_type = genomic DNA

SEQ ID NO: 388 - DNA, 210 bp, Salmonella enterica
  source 1..210: mol_type = genomic DNA
atggcaaaaataggtgagaacgtaccacttcttattgataaagccgtcgattttatggcgtccagccaggcgttccgtgaatacttgaataaaacgccgccgcgtgattatgttccttccgaagtgccgtcggagagcgcgcccatttatttgcagcgtctggaatattaccggcggctgtaccgaccaaaagaagaagaaagaggttaa

SEQ ID NO: 389 - DNA, 282 bp, Salmonella enterica
  source 1..282: mol_type = genomic DNA
atggcaaaaatggcagcagcactgcatatccttgtaaaagaagagaaaatggcattggatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccattgcacacccagttcggttatcacatcattaaggtattgtatcgcaaataa

SEQ ID NO: 390 - DNA, 393 bp, Salmonella enterica; identical to SEQ ID NO: 373
  source 1..393: mol_type = genomic DNA

SEQ ID NO: 391 - DNA, 435 bp, Salmonella enterica; identical to SEQ ID NO: 55
  source 1..435: mol_type = genomic DNA

SEQ ID NO: 392 - DNA, 384 bp, Salmonella enterica; identical to SEQ ID NO: 56
  source 1..384: mol_type = genomic DNA

SEQ ID NO: 393 - DNA, 621 bp, Salmonella enterica; identical to SEQ ID NO: 376
  source 1..621: mol_type = genomic DNA

SEQ ID NO: 394 - DNA, 312 bp, Salmonella enterica; identical to SEQ ID NO: 58
  source 1..312: mol_type = genomic DNA

SEQ ID NO: 395 - DNA, 285 bp, Salmonella enterica; identical to SEQ ID NO: 59
  source 1..285: mol_type = genomic DNA

SEQ ID NO: 396 - DNA, 471 bp, Salmonella enterica; identical to SEQ ID NO: 292
  source 1..471: mol_type = genomic DNA

SEQ ID NO: 397 - DNA, 393 bp, Salmonella enterica; identical to SEQ ID NO: 373
  source 1..393: mol_type = genomic DNA

SEQ ID NO: 398 - DNA, 435 bp, Salmonella enterica; identical to SEQ ID NO: 55
  source 1..435: mol_type = genomic DNA

SEQ ID NO: 399 - DNA, 384 bp, Salmonella enterica; identical to SEQ ID NO: 56
  source 1..384: mol_type = genomic DNA

SEQ ID NO: 400 - DNA, 621 bp, Salmonella enterica; identical to SEQ ID NO: 376
  source 1..621: mol_type = genomic DNA

SEQ ID NO: 401 - DNA, 312 bp, Salmonella enterica; identical to SEQ ID NO: 58
  source 1..312: mol_type = genomic DNA

SEQ ID NO: 402 - DNA, 285 bp, Salmonella enterica; identical to SEQ ID NO: 59
  source 1..285: mol_type = genomic DNA

SEQ ID NO: 403 - DNA, 471 bp, Salmonella enterica; identical to SEQ ID NO: 292
  source 1..471: mol_type = genomic DNA

SEQ ID NO: 404 - DNA, 393 bp, Salmonella enterica; identical to SEQ ID NO: 373
  source 1..393: mol_type = genomic DNA

SEQ ID NO: 405 - DNA, 435 bp, Salmonella enterica; identical to SEQ ID NO: 55
  source 1..435: mol_type = genomic DNA

SEQ ID NO: 406 - DNA, 384 bp, Salmonella enterica; identical to SEQ ID NO: 56
  source 1..384: mol_type = genomic DNA

SEQ ID NO: 407 - DNA, 621 bp, Salmonella enterica; identical to SEQ ID NO: 376
  source 1..621: mol_type = genomic DNA

SEQ ID NO: 408 - DNA, 312 bp, Salmonella enterica; identical to SEQ ID NO: 58
  source 1..312: mol_type = genomic DNA

SEQ ID NO: 409 - DNA, 285 bp, Salmonella enterica; identical to SEQ ID NO: 59
  source 1..285: mol_type = genomic DNA

SEQ ID NO: 410 - DNA, 471 bp, Salmonella enterica; identical to SEQ ID NO: 292
  source 1..471: mol_type = genomic DNA

SEQ ID NO: 411 - DNA, 393 bp, Salmonella enterica; identical to SEQ ID NO: 373
  source 1..393: mol_type = genomic DNA

SEQ ID NO: 412 - DNA, 435 bp, Salmonella enterica; identical to SEQ ID NO: 55
  source 1..435: mol_type = genomic DNA

SEQ ID NO: 413 - DNA, 384 bp, Salmonella enterica; identical to SEQ ID NO: 56
  source 1..384: mol_type = genomic DNA

SEQ ID NO: 414 - DNA, 621 bp, Salmonella enterica; identical to SEQ ID NO: 376
  source 1..621: mol_type = genomic DNA

SEQ ID NO: 415 - DNA, 312 bp, Salmonella enterica; identical to SEQ ID NO: 58
  source 1..312: mol_type = genomic DNA

SEQ ID NO: 416 - DNA, 285 bp, Salmonella enterica; identical to SEQ ID NO: 59
  source 1..285: mol_type = genomic DNA

SEQ ID NO: 417 - DNA, 471 bp, Salmonella enterica; identical to SEQ ID NO: 292
  source 1..471: mol_type = genomic DNA

SEQ ID NO: 418 - DNA, 393 bp, Salmonella enterica; identical to SEQ ID NO: 373
  source 1..393: mol_type = genomic DNA

SEQ ID NO: 419 - DNA, 435 bp, Salmonella enterica; identical to SEQ ID NO: 55
  source 1..435: mol_type = genomic DNA

SEQ ID NO: 420 - DNA, 384 bp, Salmonella enterica; identical to SEQ ID NO: 56
  source 1..384: mol_type = genomic DNA

SEQ ID NO: 421 - DNA, 621 bp, Salmonella enterica; identical to SEQ ID NO: 376
  source 1..621: mol_type = genomic DNA

SEQ ID NO: 422 - DNA, 312 bp, Salmonella enterica; identical to SEQ ID NO: 58
  source 1..312: mol_type = genomic DNA

SEQ ID NO: 423 - DNA, 285 bp, Salmonella enterica; identical to SEQ ID NO: 59
  source 1..285: mol_type = genomic DNA

SEQ ID NO: 424 - DNA, 471 bp, Salmonella enterica; identical to SEQ ID NO: 292
  source 1..471: mol_type = genomic DNA

SEQ ID NO: 425 - DNA, 393 bp, Salmonella enterica
  source 1..393: mol_type = genomic DNA
atgagcatgcaagatccgatcgcggatatgctgacccgtatccgtaacggtcaggccgcgaacaaagctgcggtcaccatgccttcctccaagctgaaagtggcaattgccaacgtgctgaaggaagaaggttttattgaagattttaaagttgaaggcgacaccaagccggaactggaactgactcttaagtatttccagggcaaagctgttgtagaaagcattcagcgtgtcagccgcccaggtctgcgcatctacaaacgtaaagatgagctgccgaaagttatggccggtctgggtatcgcagttgtttctacctctaaaggtgttatgactgatcgtgcagcgcgccaggctggtcttggtggcgaaattatctgctacgtagcctaa

SEQ ID NO: 426 - DNA, 435 bp, Salmonella enterica; identical to SEQ ID NO: 55
  source 1..435: mol_type = genomic DNA

SEQ ID NO: 427 - DNA, 384 bp, Salmonella enterica; identical to SEQ ID NO: 56
  source 1..384: mol_type = genomic DNA

SEQ ID NO: 428 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggatcaggtgccagcggacaaaaaaaccgtgctgcgtaacaacgcgggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 429 - DNA, 312 bp, Salmonella enterica; identical to SEQ ID NO: 58
  source 1..312: mol_type = genomic DNA

SEQ ID NO: 430 - DNA, 285 bp, Salmonella enterica; identical to SEQ ID NO: 59
  source 1..285: mol_type = genomic DNA

SEQ ID NO: 431 - DNA, 471 bp, Salmonella enterica; identical to SEQ ID NO: 292
  source 1..471: mol_type = genomic DNA

SEQ ID NO: 432 - DNA, 174 bp, Salmonella enterica; identical to SEQ ID NO: 188
  source 1..174: mol_type = genomic DNA

SEQ ID NO: 433 - DNA, 282 bp, Salmonella enterica; identical to SEQ ID NO: 348
  source 1..282: mol_type = genomic DNA

SEQ ID NO: 434 - DNA, 504 bp, Salmonella enterica; identical to SEQ ID NO: 65
  source 1..504: mol_type = genomic DNA

SEQ ID NO: 435 - DNA, 393 bp, Salmonella enterica; identical to SEQ ID NO: 425
  source 1..393: mol_type = genomic DNA

SEQ ID NO: 436 - DNA, 435 bp, Salmonella enterica; identical to SEQ ID NO: 55
  source 1..435: mol_type = genomic DNA

SEQ ID NO: 437 - DNA, 384 bp, Salmonella enterica; identical to SEQ ID NO: 56
  source 1..384: mol_type = genomic DNA

SEQ ID NO: 438 - DNA, 621 bp, Salmonella enterica; identical to SEQ ID NO: 428
  source 1..621: mol_type = genomic DNA

SEQ ID NO: 439 - DNA, 312 bp, Salmonella enterica; identical to SEQ ID NO: 58
  source 1..312: mol_type = genomic DNA

SEQ ID NO: 440 - DNA, 285 bp, Salmonella enterica; identical to SEQ ID NO: 59
  source 1..285: mol_type = genomic DNA

SEQ ID NO: 441 - DNA, 471 bp, Salmonella enterica; identical to SEQ ID NO: 292
  source 1..471: mol_type = genomic DNA

SEQ ID NO: 442 - DNA, 174 bp, Salmonella enterica; identical to SEQ ID NO: 188
  source 1..174: mol_type = genomic DNA

SEQ ID NO: 443 - DNA, 210 bp, Salmonella enterica
  source 1..210: mol_type = genomic DNA
atggcaaaaataggtgagaacgtaccacttcttattgataaagccgtcgattttatggcgtccagccaggcgttccgtgaatacctgaataaaacgccgccgcgtgattatgttccttccgaagtgccgtcggagagcgcgcccatttatttgcagcgtctggaatattaccgacggctgtaccgaccaaaagaagaagaaagaggttaa

SEQ ID NO: 444 - DNA, 282 bp, Salmonella enterica; identical to SEQ ID NO: 348
  source 1..282: mol_type = genomic DNA

SEQ ID NO: 445 - DNA, 393 bp, Salmonella enterica; identical to SEQ ID NO: 54
  source 1..393: mol_type = genomic DNA

SEQ ID NO: 446 - DNA, 435 bp, Salmonella enterica; identical to SEQ ID NO: 55
  source 1..435: mol_type = genomic DNA

SEQ ID NO: 447 - DNA, 384 bp, Salmonella enterica; identical to SEQ ID NO: 56
  source 1..384: mol_type = genomic DNA

SEQ ID NO: 448 - DNA, 621 bp, Salmonella enterica; identical to SEQ ID NO: 57
  source 1..621: mol_type = genomic DNA

SEQ ID NO: 449 - DNA, 312 bp, Salmonella enterica; identical to SEQ ID NO: 58
  source 1..312: mol_type = genomic DNA

SEQ ID NO: 450 - DNA, 285 bp, Salmonella enterica; identical to SEQ ID NO: 59
  source 1..285: mol_type = genomic DNA

SEQ ID NO: 451 - DNA, 471 bp, Salmonella enterica; identical to SEQ ID NO: 60
  source 1..471: mol_type = genomic DNA

SEQ ID NO: 452 - DNA, 174 bp, Salmonella enterica; identical to SEQ ID NO: 61
  source 1..174: mol_type = genomic DNA

SEQ ID NO: 453 - DNA, 210 bp, Salmonella enterica; identical to SEQ ID NO: 388
  source 1..210: mol_type = genomic DNA

SEQ ID NO: 454 - DNA, 282 bp, Salmonella enterica; identical to SEQ ID NO: 389
  source 1..282: mol_type = genomic DNA

SEQ ID NO: 455 - DNA, 393 bp, Salmonella enterica; identical to SEQ ID NO: 54
  source 1..393: mol_type = genomic DNA

SEQ ID NO: 456 - DNA, 435 bp, Salmonella enterica
  source 1..435: mol_type = genomic DNA
atgcatttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgcaaagcagcgattacagccgaagttcgtctgtctgacctggcgaaagtagaaggcggcgttgtagacctgaacacgctgaaagcggcaaacattatcggtattcagatcgagttcgcgaaagtgatcctggctggcgaagtcactactccggtaactgttcgtggcctgcgtgttactaaaggcgctcgtgctgctatcgaagctgctggcggtaaaatcgaggaataa

SEQ ID NO: 457 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggatcaggtgccagcggacaaaaaaaccgtgctgcgtaacaacgcgggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggcctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 458 - DNA, 471 bp, Salmonella enterica; identical to SEQ ID NO: 292
  source 1..471: mol_type = genomic DNA

SEQ ID NO: 459 - DNA, 174 bp, Salmonella enterica; identical to SEQ ID NO: 96
  source 1..174: mol_type = genomic DNA

SEQ ID NO: 460 - DNA, 221 bp, Salmonella enterica
  source 1..221: mol_type = genomic DNA
atggcaaaaataggtgagaacgtaccacttcttattgataaagccgtcgattttatggcgtccagccaggcgttccgtgaatacctgaataaaacgccgccgcgtgattatgttccttccgaagtgccgtcggagagcgcgcccatttatttgcagcgtctggaatattaccgacggctgtaccgaccaaaagaagaagaaagaggttaacggcgggattt

SEQ ID NO: 461 - DNA, 282 bp, Salmonella enterica
  source 1..282: mol_type = genomic DNA
atggcaaaaatggcagcagcactgcatatccttgtaaaagaagagaaactggcattggatcttctggagcaaattaaaaacggcggcgattttgagaagctggcgaagaaacattctatctgcccatccggtaaaaaaggcggtcatttaggcgaatttcgtcagggccagatggttccggcattcgataaagtagtcttttcctgcccggtactggagccaaccggcccattgcacacccagttcggttatcacatcattaaggtattgtatcgcaaataa

SEQ ID NO: 462 - DNA, 393 bp, Salmonella enterica
  source 1..393: mol_type = genomic DNA
atgagcatgcaagatccgatcgcggatatgctgacccgtatccgtaacggtcaggccgcgaacaaagctgcggtcaccatgccttcctccaagctgaaagtggcaattgccaacgtgctgaaggaagaaggttttattgaagattttaaagttgaaggcgacaccaagccggaactggaactgactcttaagtatttccagggtaaagctgttgtagaaagcattcagcgtgtcagccgcccaggcctgcgcatctacaaacgtaaagatgagctgccgaaagttatggccggtctgggtatcgcagttgtttctacctctaaaggtgttatgactgatcgtgcagcgcgccaggctggtcttggtggcgaaattatctgctacgtagcctaa

SEQ ID NO: 463 - DNA, 435 bp, Salmonella enterica; identical to SEQ ID NO: 55
  source 1..435: mol_type = genomic DNA

SEQ ID NO: 464 - DNA, 384 bp, Salmonella enterica; identical to SEQ ID NO: 56
  source 1..384: mol_type = genomic DNA

SEQ ID NO: 465 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtatgggaacacgcttactatctgaaattccagaaccgccgcccggactacatcaaagagttctggaacgtggtgaactgggacgaagcagcagcgcgtttcgccgctaaaaaataa

SEQ ID NO: 466 - DNA, 312 bp, Salmonella enterica; identical to SEQ ID NO: 58
  source 1..312: mol_type = genomic DNA

SEQ ID NO: 467 - DNA, 471 bp, Salmonella enterica; identical to SEQ ID NO: 292
  source 1..471: mol_type = genomic DNA

SEQ ID NO: 468 - DNA, 174 bp, Salmonella enterica; identical to SEQ ID NO: 61
  source 1..174: mol_type = genomic DNA

SEQ ID NO: 469 - DNA, 213 bp, Salmonella enterica
  source 1..213: mol_type = genomic DNA
atggcaaaaataggtgagaacgtaccacttcttattgataaagccgtcgattttatggcgtccagccaggcgttccgtgagtacttgaataaaacgccgccgcgtgactatgttccttccgaagtgccgtcggagagcgcgcccatttatttgcagcgtctggaatattaccggcggctgtaccgaccaaaagaagaaagaggttaacggcgg

SEQ ID NO: 470 - DNA, 282 bp, Salmonella enterica
  source 1..282: mol_type = genomic DNA
atggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatactcagttcggttaccacatcattaaagtattgtatcgtaaataa

SEQ ID NO: 471 - DNA, 174 bp, Salmonella enterica; identical to SEQ ID NO: 346
  source 1..174: mol_type = genomic DNA

SEQ ID NO: 472 - DNA, 210 bp, Salmonella enterica; identical to SEQ ID NO: 336
  source 1..210: mol_type = genomic DNA

SEQ ID NO: 473 - DNA, 282 bp, Salmonella enterica; identical to SEQ ID NO: 108
  source 1..282: mol_type = genomic DNA

SEQ ID NO: 474 - DNA, 504 bp, Salmonella enterica
  source 1..504: mol_type = genomic DNA
atgaatatcaaaaccgttgaagacctttttatccatctactttcagatacctatagtgcagaaaaacaattaaccaaggctcttcctaaacttgccagagccacgtccaatgaaaaattaagccaggcctttcaatctcatcttgaagaaacccagggtcagattgaacgtattgatcagatcgtcgaatctgaatctggcattaaactgaaaagaataaaatgcgtcgctatggaagggctgattgaagaagccaatgaagtcatcgaaagtacggagaaaaacgaagtacgcgatgcagcgcttatcgccgcggcgcaaaaagtcgagcattacgaaatcgccagctatggcacgctagccaccctggccgagcagctcggctatggcaaggcattaaaactgcttaaagaaaccctcgacgaggaaaaacaaactgatttaaaacttaccgatttagcagtcagcaatgttaataaaagtgctgaacgcaaatcgaaataa

SEQ ID NO: 475 - DNA, 393 bp, Salmonella enterica; identical to SEQ ID NO: 54
  source 1..393: mol_type = genomic DNA

SEQ ID NO: 476 - DNA, 435 bp, Salmonella enterica; identical to SEQ ID NO: 55
  source 1..435: mol_type = genomic DNA

SEQ ID NO: 477 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 478 - DNA, 312 bp, Salmonella enterica; identical to SEQ ID NO: 58
  source 1..312: mol_type = genomic DNA

SEQ ID NO: 479 - DNA, 471 bp, Salmonella enterica; identical to SEQ ID NO: 292
  source 1..471: mol_type = genomic DNA

SEQ ID NO: 480 - DNA, 174 bp, Salmonella enterica; identical to SEQ ID NO: 96
  source 1..174: mol_type = genomic DNA

SEQ ID NO: 481 - DNA, 210 bp, Salmonella enterica; identical to SEQ ID NO: 443
  source 1..210: mol_type = genomic DNA

SEQ ID NO: 482 - DNA, 282 bp, Salmonella enterica; identical to SEQ ID NO: 348
  source 1..282: mol_type = genomic DNA

SEQ ID NO: 483 - DNA, 393 bp, Salmonella enterica; identical to SEQ ID NO: 54
  source 1..393: mol_type = genomic DNA

SEQ ID NO: 484 - DNA, 435 bp, Salmonella enterica; identical to SEQ ID NO: 55
  source 1..435: mol_type = genomic DNA

SEQ ID NO: 485 - DNA, 384 bp, Salmonella enterica; identical to SEQ ID NO: 56
  source 1..384: mol_type = genomic DNA

SEQ ID NO: 486 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgcgggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 487 - DNA, 312 bp, Salmonella enterica; identical to SEQ ID NO: 58
  source 1..312: mol_type = genomic DNA

SEQ ID NO: 488 - DNA, 471 bp, Salmonella enterica; identical to SEQ ID NO: 292
  source 1..471: mol_type = genomic DNA

SEQ ID NO: 489 - DNA, 174 bp, Salmonella enterica; identical to SEQ ID NO: 346
  source 1..174: mol_type = genomic DNA

SEQ ID NO: 490 - DNA, 210 bp, Salmonella enterica
  source 1..210: mol_type = genomic DNA
atggcaaaaataggtgagaacgtaccacttcttattgataaagccgtcgattttatggcgtccagccaggcgttccgtgaattcaagtataaaacgccgccgcgtgattatgttccttccgaagtgccgtcggagagcgcgcccatttatttgcagcgtctggcatattaccgacggttgtaccgaccaaaagaagaagaaagaggttaa

SEQ ID NO: 491 - DNA, 282 bp, Salmonella enterica; identical to SEQ ID NO: 108
  source 1..282: mol_type = genomic DNA

SEQ ID NO: 492 - DNA, 393 bp, Salmonella enterica; identical to SEQ ID NO: 462
  source 1..393: mol_type = genomic DNA

SEQ ID NO: 493 - DNA, 435 bp, Salmonella enterica; identical to SEQ ID NO: 55
  source 1..435: mol_type = genomic DNA

SEQ ID NO: 494 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggctgaagaactgattactaaactggaccaggtgccagcggacaaaaaaaccgtgctgcgtaacaacgccggcggccacgctaaccacagcctgttctggaaagggctgaaaaaaggcaccactctgcagggcgacctgaaagcggctatcgagcgtgacttcggttccgttgacaacttcaaagctgaattcgaaaaagcagcagcaacccgtttcggctccggctgggcgtggctggtgctgaaaggcgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 495 - DNA, 312 bp, Salmonella enterica; identical to SEQ ID NO: 195
  source 1..312: mol_type = genomic DNA

SEQ ID NO: 496 - DNA, 174 bp, Salmonella enterica; identical to SEQ ID NO: 61
  source 1..174: mol_type = genomic DNA

SEQ ID NO: 497 - DNA, 210 bp, Salmonella enterica; identical to SEQ ID NO: 62
  source 1..210: mol_type = genomic DNA

SEQ ID NO: 498 - DNA, 282 bp, Salmonella enterica; identical to SEQ ID NO: 200
  source 1..282: mol_type = genomic DNA

SEQ ID NO: 499 - DNA, 393 bp, Salmonella enterica; identical to SEQ ID NO: 54
  source 1..393: mol_type = genomic DNA

SEQ ID NO: 500 - DNA, 435 bp, Salmonella enterica; identical to SEQ ID NO: 55
  source 1..435: mol_type = genomic DNA

SEQ ID NO: 501 - DNA, 384 bp, Salmonella enterica; identical to SEQ ID NO: 56
  source 1..384: mol_type = genomic DNA

SEQ ID NO: 502 - DNA, 621 bp, Salmonella enterica; identical to SEQ ID NO: 486
  source 1..621: mol_type = genomic DNA

SEQ ID NO: 503 - DNA, 312 bp, Salmonella enterica; identical to SEQ ID NO: 58
  source 1..312: mol_type = genomic DNA

SEQ ID NO: 504 - DNA, 471 bp, Salmonella enterica; identical to SEQ ID NO: 292
  source 1..471: mol_type = genomic DNA

SEQ ID NO: 505 - DNA, 174 bp, Salmonella enterica; identical to SEQ ID NO: 346
  source 1..174: mol_type = genomic DNA

SEQ ID NO: 506 - DNA, 210 bp, Salmonella enterica; identical to SEQ ID NO: 336
  source 1..210: mol_type = genomic DNA

SEQ ID NO: 507 - DNA, 282 bp, Salmonella enterica; identical to SEQ ID NO: 108
  source 1..282: mol_type = genomic DNA

SEQ ID NO: 508 - DNA, 393 bp, Salmonella enterica; identical to SEQ ID NO: 54
  source 1..393: mol_type = genomic DNA

SEQ ID NO: 509 - DNA, 435 bp, Salmonella enterica; identical to SEQ ID NO: 55
  source 1..435: mol_type = genomic DNA

SEQ ID NO: 510 - DNA, 384 bp, Salmonella enterica; identical to SEQ ID NO: 56
  source 1..384: mol_type = genomic DNA

SEQ ID NO: 511 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgccagcctgccggttgaagaactgattactaaactggaccaggtgccagcggacaaaaaaaccgtgctgcgtaacaacgcgggcggccacgctaaccacagcctgttctggaaagggctgaaaaaaggcaccactctgcagggcgacctgaaagcggctatcgagcgtgacttcggttccgttgacaacttcaaagctgaattcgaaaaagcagcagcaacccgtttcggttccggctgggcgtggctggtgctgaaaggtgacaaactggctgtggtttctaccgcaaaccaggattccccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 512 - DNA, 312 bp, Salmonella enterica; identical to SEQ ID NO: 58
  source 1..312: mol_type = genomic DNA

SEQ ID NO: 513 - DNA, 471 bp, Salmonella enterica; identical to SEQ ID NO: 292
  source 1..471: mol_type = genomic DNA

SEQ ID NO: 514 - DNA, 174 bp, Salmonella enterica
  source 1..174: mol_type = genomic DNA
atgaacagcgaagagttgacacataaagcagaagaggaaatcgcggcactcataagcaaaaaggtcgccgaactacggaagaaaaccgggcaagaggtttccgaaatagagttcgcgccgcgagaaacgatgaaagggcttgagggataccacgttaaaattaaactactctag

SEQ ID NO: 515 - DNA, 210 bp, Salmonella enterica; identical to SEQ ID NO: 244
  source 1..210: mol_type = genomic DNA

SEQ ID NO: 516 - DNA, 282 bp, Salmonella enterica
  source 1..282: mol_type = genomic DNA
atggcaaaaatggcagcagcactgcatatccttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatactcagttcggttaccacatcattaaagtattgtatcgcaaataa

SEQ ID NO: 517 - DNA, 393 bp, Salmonella enterica; identical to SEQ ID NO: 54
  source 1..393: mol_type = genomic DNA

SEQ ID NO: 518 - DNA, 435 bp, Salmonella enterica; identical to SEQ ID NO: 55
  source 1..435: mol_type = genomic DNA

SEQ ID NO: 519 - DNA, 384 bp, Salmonella enterica; identical to SEQ ID NO: 56
  source 1..384: mol_type = genomic DNA

SEQ ID NO: 520 - DNA, 621 bp, Salmonella enterica; identical to SEQ ID NO: 486
  source 1..621: mol_type = genomic DNA

SEQ ID NO: 521 - DNA, 312 bp, Salmonella enterica; identical to SEQ ID NO: 58
  source 1..312: mol_type = genomic DNA

SEQ ID NO: 522 - DNA, 471 bp, Salmonella enterica; identical to SEQ ID NO: 292
  source 1..471: mol_type = genomic DNA

SEQ ID NO: 523 - DNA, 174 bp, Salmonella enterica; identical to SEQ ID NO: 346
  source 1..174: mol_type = genomic DNA

SEQ ID NO: 524 - DNA, 210 bp, Salmonella enterica; identical to SEQ ID NO: 336
  source 1..210: mol_type = genomic DNA

SEQ ID NO: 525 - DNA, 282 bp, Salmonella enterica; identical to SEQ ID NO: 108
  source 1..282: mol_type = genomic DNA

SEQ ID NO: 526 - DNA, 393 bp, Salmonella enterica; identical to SEQ ID NO: 373
  source 1..393: mol_type = genomic DNA

SEQ ID NO: 527 - DNA, 435 bp, Salmonella enterica; identical to SEQ ID NO: 55
  source 1..435: mol_type = genomic DNA

SEQ ID NO: 528 - DNA, 384 bp, Salmonella enterica; identical to SEQ ID NO: 56
  source 1..384: mol_type = genomic DNA

SEQ ID NO: 529 - DNA, 621 bp, Salmonella enterica; identical to SEQ ID NO: 376
  source 1..621: mol_type = genomic DNA

SEQ ID NO: 530 - DNA, 471 bp, Salmonella enterica; identical to SEQ ID NO: 292
  source 1..471: mol_type = genomic DNA

SEQ ID NO: 531 - DNA, 174 bp, Salmonella enterica
  source 1..174: mol_type = genomic DNA
atgaacagcgaagagttgacacataaagcagaagaggaaatcgcggcactcattagcaaaaaggttgccgaactacggaagaaaactgggcaagaggtttccgaaatagagttcgcgccgcgagaaacgatgaaagggcttgagggataccacgttaaaattaaactactctag

SEQ ID NO: 532 - DNA, 210 bp, Salmonella enterica; identical to SEQ ID NO: 443
  source 1..210: mol_type = genomic DNA

SEQ ID NO: 533 - DNA, 282 bp, Salmonella enterica; identical to SEQ ID NO: 348
  source 1..282: mol_type = genomic DNA

SEQ ID NO: 534 - DNA, 393 bp, Salmonella enterica; identical to SEQ ID NO: 462
  source 1..393: mol_type = genomic DNA

SEQ ID NO: 535 - DNA, 435 bp, Salmonella enterica; identical to SEQ ID NO: 55
  source 1..435: mol_type = genomic DNA

SEQ ID NO: 536 - DNA, 384 bp, Salmonella enterica; identical to SEQ ID NO: 56
  source 1..384: mol_type = genomic DNA

SEQ ID NO: 537 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgcgggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggtgacaaactggctgtggtttctaccgcaaaccaggattctccgctgatgggtgaagccatttccggcgcttccggcttcccgatcctgggtctggacgtgtgggaacacgcttactacctgaaattccagaaccgccgcccggactacatcaaagagttctggaacgtggtgaactgggacgaagcagcagcgcgtttcgccgctaaaaaataa

SEQ ID NO: 538 - DNA, 312 bp, Salmonella enterica; identical to SEQ ID NO: 58
  source 1..312: mol_type = genomic DNA

SEQ ID NO: 539 - DNA, 285 bp, Salmonella enterica
  source 1..285: mol_type = genomic DNA
atgtttactatcaacgcagaagtacgtaaagagcagggtaagggtgcgagccgccgcctgcgcgccgctaacaagttcccggcaatcatctacggcggttctgaagccccggttgctatcgaactggaccacgaccaggtgatgaacatgcaagctaaagctgaattctacagcgaagttctgaccctcgttgttgacggtaaagaagtaaaagttaaagctcaggctgtacagcgtcacgcttacaaaccgaagctgactcacatcgacttcgttcgcgcgtaa

SEQ ID NO: 540 - DNA, 375 bp, Salmonella enterica
  source 1..375: mol_type = genomic DNA
atggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcactgcgtaaagtttgccgtgttcgtctgactaacggttttgaagtgacttcctacatcggtggtgaaggtcacaacctgcaggagcactccgtgatcctgatccgtggcggtcgtgttaaagacctcccgggtgttcgttaccacaccgttcgtggcgcgcttgactgctccggcgttaaagaccgtaagcaagctcgttctaagtacggcgtgaagcgtcctaaggcttaa

SEQ ID NO: 541 - DNA, 174 bp, Salmonella enterica
  source 1..174: mol_type = genomic DNA
atgaacagcgaagagttgacacataaagcagaagaggaaatcgcggcactcattagcaaaaaagtcgccgaactacggaagaaaaccgggcaagaggtttccgaaatagagttcgtgccgcgagaaacgatgaaagggcttgagggctaccacgttaaaattaaactactctag

SEQ ID NO: 542 - DNA, 210 bp, Salmonella enterica; identical to SEQ ID NO: 388
  source 1..210: mol_type = genomic DNA

SEQ ID NO: 543 - DNA, 282 bp, Salmonella enterica; identical to SEQ ID NO: 327
  source 1..282: mol_type = genomic DNA

SEQ ID NO: 544 - DNA, 393 bp, Salmonella enterica; identical to SEQ ID NO: 54
  source 1..393: mol_type = genomic DNA

SEQ ID NO: 545 - DNA, 435 bp, Salmonella enterica; identical to SEQ ID NO: 55
  source 1..435: mol_type = genomic DNA

SEQ ID NO: 546 - DNA, 384 bp, Salmonella enterica; identical to SEQ ID NO: 56
  source 1..384: mol_type = genomic DNA

SEQ ID NO: 547 - DNA, 621 bp, Salmonella enterica
  source 1..621: mol_type = genomic DNA
atgagttatacactgccatccctgccgtacgcttatgatgcactggaaccgcacttcgataagcagacgatggagattcaccacaccaaacaccatcaaacctatgtcaacaacgctaacgcggcgctggaaaacctgcctgagtttgctgacctgccggttgaagaactgattactaaactggaccaggtgccagcggacaaaaaaaccgtgctgcgtaacaacgccggcggccacgctaaccacagcctgttctggaaagggctgaaaaaaggcaccactctgcagggcgatctgaaagcggctatcgagcgtgacttcggttccgttgacaacttcaaagctgaattcgaaaaagcagcagcaacccgtttcggctccggctgggcgtggctggtgctgaaaggcgataaactggctgtggtttctaccgctaaccaggattccccgctgatgggtgaagccatttccggcgcttccggcttcccgatcctgggtctggacgtgtgggaacacgcttactatctgaaattccagaaccgccgcccggactacatcaaagagttctggaacgtggtgaactgggacgaagcagcagcgcgtttcgccgctaaaaaataa

SEQ ID NO: 548 - DNA, 312 bp, Salmonella enterica; identical to SEQ ID NO: 58
  source 1..312: mol_type = genomic DNA

SEQ ID NO: 549 - DNA, 285 bp, Salmonella enterica; identical to SEQ ID NO: 539
  source 1..285: mol_type = genomic DNA

SEQ ID NO: 550 - DNA, 471 bp, Salmonella enterica; identical to SEQ ID NO: 292
  source 1..471: mol_type = genomic DNA

SEQ ID NO: 551 - DNA, 174 bp, Salmonella enterica
  source 1..174: mol_type = genomic DNA
atgaacagcgaagagttgacacataaagcagaagaggaaatcgcggcactcattagcaaaaaggtcgccgaactacggaagaaaaccgggcaagaggtttccgaaatagagttcgtgccgcgagaaacgatgaaagggcttgagggctaccacgttaaaattaaactactctag

SEQ ID NO: 552 - DNA, 210 bp, Salmonella enterica; identical to SEQ ID NO: 62
  source 1..210: mol_type = genomic DNA

SEQ ID NO: 553 - DNA, 282 bp, Salmonella enterica
  source 1..282: mol_type = genomic DNA
atggcaaaaatggcagcagcactgcatattcttgtaaaagaagagaaactagctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccgctgcatacccagttcggttaccacatcattaaagtattgtatcgcaaataa

SEQ ID NO: 554 - DNA, 393 bp, Salmonella enterica; identical to SEQ ID NO: 54
  source 1..393: mol_type = genomic DNA

SEQ ID NO: 555 - DNA, 435 bp, Salmonella enterica; identical to SEQ ID NO: 55
  source 1..435: mol_type = genomic DNA

SEQ ID NO: 556 - DNA, 779 bp, Salmonella enterica
  source 1..779: mol_type = genomic DNA
gtgaaagaagagaaaccagaattcgatccgatctgctgcgcctgttgacgatctggaatttactggtccgctctgctaactgcctcaaggcagaagctatccactatatcggtgatctggtacagcgtaccgaggttgagcttcttaagacgcctaacctgggtaaaaaatctcttaccgagattaaagacgtgctggcttcccgtggactgtctctgggtatgcgcctggaaaactggccaccggcaagcatcgctgacgagtaaccggatcacaggttaaggttttactgagaaggataaggtcatgcgccatcgtaagagtggtcgtcaactgaaccgcaacagcagccatcgccaggctatgttccgcaacatggcaggttcactggttcgtcatgaaatcatcaagacgaccctgcctaaagcgaaagagctgcgtcgcgtagttgagccgctgattactcttgccaagactgatagcgttgctaatcgtcgtctggcattcgcccgtactcgtgataacgagatcgtggcaaaactgtttaacgagctgggcccgcgtttcgcgagccgcgccggtggttacactcgcattctgaagtgtggcttccgtgcaggcgacaacgcgccgatggcatacatcgagctggttgatcgttcagagaaaacagaagctgctgcagagtaatctgtagtaacgtaaaaaaacccgcttcggcgggtttttttataccctcctgaaccccatgtatctacaataattgtattcttttcgtt

SEQ ID NO: 557 - DNA, 621 bp, Salmonella enterica; identical to SEQ ID NO: 494
  source 1..621: mol_type = genomic DNA

SEQ ID NO: 558 - DNA, 312 bp, Salmonella enterica; identical to SEQ ID NO: 195
  source 1..312: mol_type = genomic DNA

SEQ ID NO: 559 - DNA, 471 bp, Salmonella enterica; identical to SEQ ID NO: 292
  source 1..471: mol_type = genomic DNA

SEQ ID NO: 560 - DNA, 174 bp, Salmonella enterica; identical to SEQ ID NO: 61
  source 1..174: mol_type = genomic DNA

SEQ ID NO: 561 - DNA, 282 bp, Salmonella enterica
  source 1..282: mol_type = genomic DNA
atggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtattttcctgcccggtactggagccaaccggcccgctgcatacccagttcggttaccacatcattaaagtattgtatcgcaaataa

SEQ ID NO: 562 - DNA, 393 bp, Salmonella enterica; identical to SEQ ID NO: 54
  source 1..393: mol_type = genomic DNA

SEQ ID NO: 563 - DNA, 435 bp, Salmonella enterica; identical to SEQ ID NO: 55
  source 1..435: mol_type = genomic DNA

SEQ ID NO: 564 - DNA, 384 bp, Salmonella enterica; identical to SEQ ID NO: 56
  source 1..384: mol_type = genomic DNA

SEQ ID NO: 565 - DNA, 621 bp, Salmonella enterica; identical to SEQ ID NO: 494
  source 1..621: mol_type = genomic DNA

SEQ ID NO: 566 - DNA, 471 bp, Salmonella enterica; identical to SEQ ID NO: 292
  source 1..471: mol_type = genomic DNA

SEQ ID NO: 567 - DNA, 174 bp, Salmonella enterica; identical to SEQ ID NO: 61
  source 1..174: mol_type = genomic DNA

SEQ ID NO: 568 - DNA, 282 bp, Salmonella enterica; identical to SEQ ID NO: 561
  source 1..282: mol_type = genomic DNA

SEQ ID NO: 569 - DNA, 393 bp, Salmonella enterica; identical to SEQ ID NO: 54
  source 1..393: mol_type = genomic DNA

SEQ ID NO: 570 - DNA, 435 bp, Salmonella enterica; identical to SEQ ID NO: 55
  source 1..435: mol_type = genomic DNA

SEQ ID NO: 571 - DNA, 384 bp, Salmonella enterica; identical to SEQ ID NO: 56
  source 1..384: mol_type = genomic DNA

SEQ ID NO: 572 - DNA, 312 bp, Salmonella enterica; identical to SEQ ID NO: 195
  source 1..312: mol_type = genomic DNA

SEQ ID NO: 573 - DNA, 471 bp, Salmonella enterica; identical to SEQ ID NO: 292
  source 1..471: mol_type = genomic DNA

SEQ ID NO: 574 - DNA, 174 bp, Salmonella enterica; identical to SEQ ID NO: 61
  source 1..174: mol_type = genomic DNA

SEQ ID NO: 575 - DNA, 282 bp, Salmonella enterica; identical to SEQ ID NO: 561
  source 1..282: mol_type = genomic DNA

SEQ ID NO: 576 - protein, 206 aa, Salmonella enterica
MSYTLPSLPYAYDALEPHFDKQTMEIHHTKHHQTYVNNANAALENLPEFASLPVEELITKLDQVPADKKTVLRNNAGGHANHSLFWKGLKKGTTLQGDLKAAIERDFGSVDNFKAEFEKAAATRFGSGWAWLVLKGDKLAVVSTANQDSPLMGEAISGASGFPILGLDVWEHAYYLKFQNRRPDYIKEFWNVVNWDEAAARFAAKK

SEQ ID NO: 577 - protein, 127 aa, Salmonella enterica
MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAE

SEQ ID NO: 578 - protein, 103 aa, Salmonella enterica
MYAVFQSGGKQHRVSEGQTVRLEKLDIATGETIEFAEVLMIANGEEVKIGVPFVDGGVIKAEVVAHGRGEKVKIVKFRRRKHYRKQQGHRQWFTDVKITGISA

SEQ ID NO: 579 - protein, 130 aa, Salmonella enterica
MSMQDPIADMLTRIRNGQAANKAAVTMPSSKLKVAIANVLKEEGFIEDFKVEGDTKPELELTLKYFQGKAVVESIQRVSRPGLRIYKRKDELPKVMAGLGIAVVSTSKGVMTDRAARQAGLGGEIICYVA

SEQ ID NO: 580 - protein, 144 aa, Salmonella enterica
MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE

SEQ ID NO: 581 - protein, 156 aa, Salmonella enterica
MPRRRVIGQRKILPDPKFGSELLAKFVNILMVDGKKSTAESIVYSALETLAQRSGKSELEAFEVALENVRPTVEVKSRRVGGSTYQVPVEVRPVRRNALAMRWIVEAARKRGDKSMALRLANELSDAADNKGTAVKKREDVHRMAEANKAFAHYRW

SEQ ID NO: 582 - protein, 57 aa, Salmonella enterica
MNSEELTHKAEEEIAALISKKVAELRKKTGQEVSEIEFAPRETMKGLEGYHVKIKLL

SEQ ID NO: 583 - protein, 69 aa, Salmonella enterica
MAKIGENVPLLIDKAVDFMASSQAFREYLNKTPPRDYVPSEVPSESAPIYLQRLEYYRRLYRPKEEERG

SEQ ID NO: 584 - protein, 93 aa, Salmonella enterica
MAKMAAALHILVKEEKLALDLLEQIKNGGDFEKLAKKHSICPSGKKGGHLGEFRQGQMVPAFDKVVFSCPVLEPTGPLHTQFGYHIIKVLYRK

SEQ ID NO: 585 - protein, 94 aa, Salmonella enterica
MFTINAEVRKEQGKGASRRLRAANKFPAIIYGGSEAPIAIELDHDQVMNMQAKAEFYSEVLTLVVDGKEVKVKAQAVQRHAYKPKLTHIDFVRA

SEQ ID NO: 586 - protein, 63 aa, Salmonella enterica
MPTRPPYPREAYIVTIEKGTPGQTVTWYQLRADHPKPDSLISEHPTAEEAMDAKNRYEDPDKS

SEQ ID NO: 587 - protein, 167 aa, Salmonella enterica
MNIKTVEDLFIHLLSDTYSAEKQLTKALPKLARATSNEKLSQAFQSHLEETQGQIERIDQIVESESGIKLKRMKCVAMEGLIEEANEVIESTEKNEVRDAALIAAAQKVEHYEIASYGTLATLAEQLGYSKALKLLKETLDEEKQTDLKLTDLAVSNVNKSAERKSK

SEQ ID NO: 588 - protein, 206 aa, Salmonella enterica
MSYTLPSLPYAYDALEPHFDKQTMEIHHTKHHQTYVNNANAALENLPEFADLPVEELITKLDQVPADKKTVLRNNAGGHANHSFFWKGLKKGTTLQGDLKAAIERDFGSVDNFKAEFEKAAATRFGSGWAWLVLKGDKLAVVSTANQDSPLMGEAISGASGFPILGLDVWEHAYYLKFQNRRPDYIKEFWNVVNWDEAAARFAAKK

SEQ ID NO: 589 - protein, 127 aa, Salmonella enterica; identical to SEQ ID NO: 577

SEQ ID NO: 590 - protein, 103 aa, Salmonella enterica; identical to SEQ ID NO: 578

SEQ ID NO: 591 - protein, 130 aa, Salmonella enterica; identical to SEQ ID NO: 579

SEQ ID NO: 592 - protein, 144 aa, Salmonella enterica; identical to SEQ ID NO: 580

SEQ ID NO: 593 - protein, 156 aa, Salmonella enterica
MPRRRVIGQRKILPDPKFGSELLAKFVNILMVDGKKSTAESIVYSALETLAQRSGKSELEAFEVALENVRPTVEVKSRRVGGSTYQVPVEVRPVRRNALAMRWIVEAARKRGDKSMALRLANELSDAAENKGTAVKKREDVHRMAEANKAFAHYRW

SEQ ID NO: 594 - protein, 94 aa, Salmonella enterica; identical to SEQ ID NO: 585

SEQ ID NO: 595 - protein, 63 aa, Salmonella enterica
MPTRPPYPREAYIVTIEKGTPGQTVTWYQLRADHPKPDSLISEHPTAEEAMDAKKRYEDPDKS

SEQ ID NO: 596 - protein, 167 aa, Salmonella enterica
MNIKTVEDLFIHLLSDTYSAEKQLTKALSKLARATSNEKLSQAFQSHLEETQGQIERIDQIVESESGIKLKRMKCVAMEGLIEEANEVIESTEKNEVRDAALIAAAQKVEHYEIASYGTLATLAEQLGYSKALKLLKETLDEEKQTDLKLTDLAVSNVNKSAERKSK

SEQ ID NO: 597 - protein, 206 aa, Salmonella enterica; identical to SEQ ID NO: 588

SEQ ID NO: 598 - protein, 127 aa, Salmonella enterica; identical to SEQ ID NO: 577

SEQ ID NO: 599 - protein, 103 aa, Salmonella enterica; identical to SEQ ID NO: 578

SEQ ID NO: 600 - protein, 130 aa, Salmonella enterica; identical to SEQ ID NO: 579

SEQ ID NO: 601 - protein, 144 aa, Salmonella enterica; identical to SEQ ID NO: 580

SEQ ID NO: 602 - protein, 156 aa, Salmonella enterica; identical to SEQ ID NO: 593

SEQ ID NO: 603 - protein, 94 aa, Salmonella enterica; identical to SEQ ID NO: 585

SEQ ID NO: 604 - protein, 206 aa, Salmonella enterica; identical to SEQ ID NO: 588

SEQ ID NO: 605 - protein, 127 aa, Salmonella enterica; identical to SEQ ID NO: 577

SEQ ID NO: 606 - protein, 103 aa, Salmonella enterica; identical to SEQ ID NO: 578

SEQ ID NO: 607 - protein, 130 aa, Salmonella enterica; identical to SEQ ID NO: 579

SEQ ID NO: 608 - protein, 144 aa, Salmonella enterica; identical to SEQ ID NO: 580

SEQ ID NO: 609 - protein, 156 aa, Salmonella enterica; identical to SEQ ID NO: 593

SEQ ID NO: 610 - protein, 94 aa, Salmonella enterica; identical to SEQ ID NO: 585

SEQ ID NO: 611 - protein, 206 aa, Salmonella enterica; identical to SEQ ID NO: 588

SEQ ID NO: 612 - protein, 127 aa, Salmonella enterica; identical to SEQ ID NO: 577

SEQ ID NO: 613 - protein, 103 aa, Salmonella enterica; identical to SEQ ID NO: 578

SEQ ID NO: 614 - protein, 130 aa, Salmonella enterica; identical to SEQ ID NO: 579

SEQ ID NO: 615 - protein, 144 aa, Salmonella enterica; identical to SEQ ID NO: 580

SEQ ID NO: 616 - protein, 156 aa, Salmonella enterica; identical to SEQ ID NO: 593

SEQ ID NO: 617 - protein, 57 aa, Salmonella enterica; identical to SEQ ID NO: 582

SEQ ID NO: 618 - protein, 69 aa, Salmonella enterica; identical to SEQ ID NO: 583

SEQ ID NO: 619 - protein, 93 aa, Salmonella enterica; identical to SEQ ID NO: 584

SEQ ID NO: 620 - protein, 94 aa, Salmonella enterica; identical to SEQ ID NO: 585

SEQ ID NO: 621 - protein, 206 aa, Salmonella enterica; identical to SEQ ID NO: 588

SEQ ID NO: 622 - protein, 127 aa, Salmonella enterica; identical to SEQ ID NO: 577

SEQ ID NO: 623 - protein, 103 aa, Salmonella enterica; identical to SEQ ID NO: 578

SEQ ID NO: 624 - protein, 130 aa, Salmonella enterica; identical to SEQ ID NO: 579

SEQ ID NO: 625 - protein, 144 aa, Salmonella enterica; identical to SEQ ID NO: 580

SEQ ID NO: 626 - protein, 156 aa, Salmonella enterica; identical to SEQ ID NO: 593

SEQ ID NO: 627 - protein, 57 aa, Salmonella enterica; identical to SEQ ID NO: 582

SEQ ID NO: 628 - protein, 69 aa, Salmonella enterica; identical to SEQ ID NO: 583

SEQ ID NO: 629 - protein, 93 aa, Salmonella enterica; identical to SEQ ID NO: 584

SEQ ID NO: 630 - protein, 206 aa, Salmonella enterica; identical to SEQ ID NO: 588

SEQ ID NO: 631 - protein, 127 aa, Salmonella enterica; identical to SEQ ID NO: 577

SEQ ID NO: 632 - protein, 103 aa, Salmonella enterica; identical to SEQ ID NO: 578

SEQ ID NO: 633 - protein, 130 aa, Salmonella enterica; identical to SEQ ID NO: 579

SEQ ID NO: 634 - protein, 144 aa, Salmonella enterica; identical to SEQ ID NO: 580

SEQ ID NO: 635 - protein, 156 aa, Salmonella enterica; identical to SEQ ID NO: 593

SEQ ID NO: 636 - protein, 94 aa, Salmonella enterica; identical to SEQ ID NO: 585

SEQ ID NO: 637 - protein, 206 aa, Salmonella enterica; identical to SEQ ID NO: 588

SEQ ID NO: 638 - protein, 127 aa, Salmonella enterica
MRHRKSGRQLNRNSSHRQAMFRNMAGSLVRHEIIKTTLPKAKELRRVVEPLITLAKTDSVANRRLAFARTRDNEIVAKLFNDLGPRFASRAGGYTRILKCGFRAGDNAPMAYIELVDRSEKTEAAAE

SEQ ID NO: 639 - protein, 103 aa, Salmonella enterica; identical to SEQ ID NO: 578

SEQ ID NO: 640 - protein, 130 aa, Salmonella enterica; identical to SEQ ID NO: 579

SEQ ID NO: 641 - protein, 144 aa, Salmonella enterica; identical to SEQ ID NO: 580

SEQ ID NO: 642 - protein, 156 aa, Salmonella enterica; identical to SEQ ID NO: 593

SEQ ID NO: 643 - protein, 57 aa, Salmonella enterica; identical to SEQ ID NO: 582

SEQ ID NO: 644 - protein, 69 aa, Salmonella enterica
MAKIGENVPLLIDKAVDFKASSQAFREYLNKTPPRDYVPSEVPSESAPIYLQRLEYYRRLYRPKEEERG

SEQ ID NO: 645 - protein, 93 aa, Salmonella enterica; identical to SEQ ID NO: 584

SEQ ID NO: 646 - protein, 94 aa, Salmonella enterica; identical to SEQ ID NO: 585

SEQ ID NO: 647 - protein, 206 aa, Salmonella enterica; identical to SEQ ID NO: 588

SEQ ID NO: 648 - protein, 127 aa, Salmonella enterica; identical to SEQ ID NO: 577

SEQ ID NO: 649 - protein, 103 aa, Salmonella enterica; identical to SEQ ID NO: 578

SEQ ID NO: 650 - protein, 130 aa, Salmonella enterica; identical to SEQ ID NO: 579

SEQ ID NO: 651 - protein, 144 aa, Salmonella enterica; identical to SEQ ID NO: 580

SEQ ID NO: 652 - protein, 156 aa, Salmonella enterica; identical to SEQ ID NO: 593

SEQ ID NO: 653 - protein, 94 aa, Salmonella enterica; identical to SEQ ID NO: 585

SEQ ID NO: 654 - protein, 206 aa, Salmonella enterica; identical to SEQ ID NO: 576

SEQ ID NO: 655 - protein, 127 aa, Salmonella enterica; identical to SEQ ID NO: 577

SEQ ID NO: 656 - protein, 103 aa, Salmonella enterica; identical to SEQ ID NO: 578

SEQ ID NO: 657 - protein, 130 aa, Salmonella enterica; identical to SEQ ID NO: 579

SEQ ID NO: 658 - protein, 144 aa, Salmonella enterica; identical to SEQ ID NO: 580

SEQ ID NO: 659 - protein, 156 aa, Salmonella enterica; identical to SEQ ID NO: 581

SEQ ID NO: 660 - protein, 94 aa, Salmonella enterica; identical to SEQ ID NO: 585

SEQ ID NO: 661 - protein, 206 aa, Salmonella enterica; identical to SEQ ID NO: 576

SEQ ID NO: 662 - protein, 127 aa, Salmonella enterica; identical to SEQ ID NO: 577

SEQ ID NO: 663 - protein, 103 aa, Salmonella enterica; identical to SEQ ID NO: 578

SEQ ID NO: 664 - protein, 130 aa, Salmonella enterica; identical to SEQ ID NO: 579

SEQ ID NO: 665 - protein, 144 aa, Salmonella enterica; identical to SEQ ID NO: 580

SEQ ID NO: 666 - protein, 156 aa, Salmonella enterica; identical to SEQ ID NO: 581

SEQ ID NO: 667 - protein, 94 aa, Salmonella enterica; identical to SEQ ID NO: 585

SEQ ID NO: 668 - protein, 206 aa, Salmonella enterica; identical to SEQ ID NO: 576

SEQ ID NO: 669 - protein, 127 aa, Salmonella enterica; identical to SEQ ID NO: 577

SEQ ID NO: 670 - protein, 103 aa, Salmonella enterica; identical to SEQ ID NO: 578

SEQ ID NO: 671 - protein, 130 aa, Salmonella enterica; identical to SEQ ID NO: 579

SEQ ID NO: 672 - protein, 144 aa, Salmonella enterica; identical to SEQ ID NO: 580

SEQ ID NO: 673 - protein, 156 aa, Salmonella enterica; identical to SEQ ID NO: 581

SEQ ID NO: 674 - protein, 94 aa, Salmonella enterica; identical to SEQ ID NO: 585

SEQ ID NO: 675 - protein, 206 aa, Salmonella enterica; identical to SEQ ID NO: 576

SEQ ID NO: 676 - protein, 127 aa, Salmonella enterica; identical to SEQ ID NO: 577

SEQ ID NO: 677 - protein, 103 aa, Salmonella enterica; identical to SEQ ID NO: 578

SEQ ID NO: 678 - protein, 130 aa, Salmonella enterica; identical to SEQ ID NO: 579

SEQ ID NO: 679 - protein, 144 aa, Salmonella enterica; identical to SEQ ID NO: 580

SEQ ID NO: 680 - protein, 156 aa, Salmonella enterica; identical to SEQ ID NO: 581

SEQ ID NO: 681 - protein, 94 aa, Salmonella enterica; identical to SEQ ID NO: 585

SEQ ID NO: 682 - protein, 206 aa, Salmonella enterica; identical to SEQ ID NO: 576

SEQ ID NO: 683 - protein, 127 aa, Salmonella enterica; identical to SEQ ID NO: 577

SEQ ID NO: 684 - protein, 103 aa, Salmonella enterica; identical to SEQ ID NO: 578

SEQ ID NO: 685 - protein, 130 aa, Salmonella enterica; identical to SEQ ID NO: 579

SEQ ID NO: 686 - protein, 144 aa, Salmonella enterica; identical to SEQ ID NO: 580

SEQ ID NO: 687 - protein, 156 aa, Salmonella enterica; identical to SEQ ID NO: 581

SEQ ID NO: 688 - protein, 94 aa, Salmonella enterica; identical to SEQ ID NO: 585

SEQ ID NO: 689 - protein, 206 aa, Salmonella enterica; identical to SEQ ID NO: 576

SEQ ID NO: 690 - protein, 127 aa, Salmonella enterica; identical to SEQ ID NO: 577

SEQ ID NO: 691 - protein, 103 aa, Salmonella enterica; identical to SEQ ID NO: 578

SEQ ID NO: 692 - protein, 130 aa, Salmonella enterica; identical to SEQ ID NO: 579

SEQ ID NO: 693 - protein, 156 aa, Salmonella enterica; identical to SEQ ID NO: 581

SEQ ID NO: 694 - protein, 94 aa, Salmonella enterica; identical to SEQ ID NO: 585

SEQ ID NO: 695 - protein, 206 aa, Salmonella enterica; identical to SEQ ID NO: 576

SEQ ID NO: 696 - protein, 127 aa, Salmonella enterica; identical to SEQ ID NO: 577

SEQ ID NO: 697 - protein, 103 aa, Salmonella enterica; identical to SEQ ID NO: 578

SEQ ID NO: 698 - protein, 130 aa, Salmonella enterica; identical to SEQ ID NO: 579

SEQ ID NO: 699 - protein, 144 aa, Salmonella enterica; identical to SEQ ID NO: 580

SEQ ID NO: 700 - protein, 156 aa, Salmonella enterica; identical to SEQ ID NO: 581

SEQ ID NO: 701 - protein, 94 aa, Salmonella enterica; identical to SEQ ID NO: 585

SEQ ID NO: 702 - protein, 206 aa, Salmonella enterica; identical to SEQ ID NO: 576

SEQ ID NO: 703 - protein, 127 aa, Salmonella enterica; identical to SEQ ID NO: 577

SEQ ID NO: 704 - protein, 103 aa, Salmonella enterica; identical to SEQ ID NO: 578

SEQ ID NO: 705 - protein, 130 aa, Salmonella enterica; identical to SEQ ID NO: 579

SEQ ID NO: 706 - protein, 144 aa, Salmonella enterica; identical to SEQ ID NO: 580

SEQ ID NO: 707 - protein, 156 aa, Salmonella enterica; identical to SEQ ID NO: 581

SEQ ID NO: 708 - protein, 57 aa, Salmonella enterica
MNSEELTHKAEEEIAALISKKVAELRKKTGQEVSEIEFVPRETMKGLEGYHVKIKLL

SEQ ID NO: 709 - protein, 69 aa, Salmonella enterica; identical to SEQ ID NO: 583

SEQ ID NO: 710 - protein, 93 aa, Salmonella enterica; identical to SEQ ID NO: 584

SEQ ID NO: 711 - protein, 94 aa, Salmonella enterica; identical to SEQ ID NO: 585

SEQ ID NO: 712 - protein, 206 aa, Salmonella enterica
MSYTLPSLPYAYDALEPHFDKQTMEIHHTKHHQTYVNNANAALENLPEFADLPVEELITKLDQVPADKKTVLRNNAGGHANHSLFWKGLKKGTTLQGDLKAAIERDFGSVDNFKAEFEKAAATRFGSGWAWLVLKGDKLAVVSTANQDSPLMGEAISGASGFPILGLDVWEHAYYLKFQNRRPDYIKEFWNVVNWDEAAARFAAKK

SEQ ID NO: 713 - protein, 127 aa, Salmonella enterica; identical to SEQ ID NO: 577

SEQ ID NO: 714 - protein, 103 aa, Salmonella enterica
MYAVFQSGGKQHRVSEGQTVRLEKLDIATGETIEFAEVLMVANGEEVKIGVPFVDGGVIKAEVVAHGRGEKVKIVKFRRRKHYRKQQGHRQWFTDVKITGISA

SEQ ID NO: 715 - protein, 130 aa, Salmonella enterica; identical to SEQ ID NO: 579

SEQ ID NO: 716 - protein, 144 aa, Salmonella enterica; identical to SEQ ID NO: 580

SEQ ID NO: 717 - protein, 156 aa, Salmonella enterica; identical to SEQ ID NO: 581

SEQ ID NO: 718 - protein, 57 aa, Salmonella enterica; identical to SEQ ID NO: 582

SEQ ID NO: 719 - protein, 69 aa, Salmonella enterica; identical to SEQ ID NO: 583

SEQ ID NO: 720 - protein, 93 aa, Salmonella enterica; identical to SEQ ID NO: 584

SEQ ID NO: 721 - protein, 94 aa, Salmonella enterica; identical to SEQ ID NO: 585

SEQ ID NO: 722 - protein, 206 aa, Salmonella enterica; identical to SEQ ID NO: 712

SEQ ID NO: 723 - protein, 127 aa, Salmonella enterica; identical to SEQ ID NO: 577

SEQ ID NO: 724 - protein, 103 aa, Salmonella enterica; identical to SEQ ID NO: 714

SEQ ID NO: 725 - protein, 130 aa, Salmonella enterica; identical to SEQ ID NO: 579

SEQ ID NO: 726 - protein, 144 aa, Salmonella enterica; identical to SEQ ID NO: 580

SEQ ID NO: 727 - protein, 156 aa, Salmonella enterica; identical to SEQ ID NO: 581

SEQ ID NO: 728 - protein, 94 aa, Salmonella enterica; identical to SEQ ID NO: 585

SEQ ID NO: 729 - protein, 206 aa, Salmonella enterica; identical to SEQ ID NO: 712

SEQ ID NO: 730 - protein, 127 aa, Salmonella enterica; identical to SEQ ID NO: 577

SEQ ID NO: 731 - protein, 103 aa, Salmonella enterica; identical to SEQ ID NO: 714

SEQ ID NO: 732 - protein, 130 aa, Salmonella enterica; identical to SEQ ID NO: 579

SEQ ID NO: 733 - protein, 144 aa, Salmonella enterica; identical to SEQ ID NO: 580

SEQ ID NO: 734 - protein, 156 aa, Salmonella enterica; identical to SEQ ID NO: 581

SEQ ID NO: 735 - protein, 94 aa, Salmonella enterica; identical to SEQ ID NO: 585

SEQ ID NO: 736 - protein, 206 aa, Salmonella enterica; identical to SEQ ID NO: 712

SEQ ID NO: 737 - protein, 127 aa, Salmonella enterica; identical to SEQ ID NO: 577

SEQ ID NO: 738 - protein, 103 aa, Salmonella enterica; identical to SEQ ID NO: 714

SEQ ID NO: 739 - protein, 130 aa, Salmonella enterica; identical to SEQ ID NO: 579

SEQ ID NO: 740 - protein, 144 aa, Salmonella enterica; identical to SEQ ID NO: 580

SEQ ID NO: 741 - protein, 156 aa, Salmonella enterica; identical to SEQ ID NO: 581

SEQ ID NO: 742 - protein, 94 aa, Salmonella enterica; identical to SEQ ID NO: 585

SEQ ID NO: 743 - protein, 206 aa, Salmonella enterica; identical to SEQ ID NO: 712

SEQ ID NO: 744 - protein, 127 aa, Salmonella enterica; identical to SEQ ID NO: 577

SEQ ID NO: 745 - protein, 103 aa, Salmonella enterica; identical to SEQ ID NO: 714

SEQ ID NO: 746 - protein, 130 aa, Salmonella enterica; identical to SEQ ID NO: 579

SEQ ID NO: 747 - protein, 144 aa, Salmonella enterica; identical to SEQ ID NO: 580

SEQ ID NO: 748 - protein, 156 aa, Salmonella enterica; identical to SEQ ID NO: 581

SEQ ID NO: 749 - protein, 94 aa, Salmonella enterica; identical to SEQ ID NO: 585

SEQ ID NO: 750 - protein, 206 aa, Salmonella enterica; identical to SEQ ID NO: 712

SEQ ID NO: 751 - protein, 127 aa, Salmonella enterica; identical to SEQ ID NO: 577

SEQ ID NO: 752 - protein, 103 aa, Salmonella enterica; identical to SEQ ID NO: 714

SEQ ID NO: 753 - protein, 130 aa, Salmonella enterica; identical to SEQ ID NO: 579

SEQ ID NO: 754 - protein, 144 aa, Salmonella enterica; identical to SEQ ID NO: 580

SEQ ID NO: 755 - protein, 156 aa, Salmonella enterica; identical to SEQ ID NO: 581

SEQ ID NO: 756 - protein, 94 aa, Salmonella enterica; identical to SEQ ID NO: 585

SEQ ID NO: 757 - protein, 206 aa, Salmonella enterica; identical to SEQ ID NO: 588

SEQ ID NO: 758 - protein, 127 aa, Salmonella enterica; identical to SEQ ID NO: 577

SEQ ID NO: 759 - protein, 103 aa, Salmonella enterica; identical to SEQ ID NO: 578

SEQ ID NO: 760 - protein, 130 aa, Salmonella enterica; identical to SEQ ID NO: 579

SEQ ID NO: 761 - protein, 144 aa, Salmonella enterica; identical to SEQ ID NO: 580

SEQ ID NO: 762 - protein, 156 aa, Salmonella enterica; identical to SEQ ID NO: 581

SEQ ID NO: 763 - protein, 57 aa, Salmonella enterica; identical to SEQ ID NO: 582

SEQ ID NO: 764 - protein, 69 aa, Salmonella enterica; identical to SEQ ID NO: 583

SEQ ID NO: 765 - protein, 93 aa, Salmonella enterica; identical to SEQ ID NO: 584

SEQ ID NO: 766 - protein, 94 aa, Salmonella enterica; identical to SEQ ID NO: 585

SEQ ID NO: 767 - protein, 206 aa, Salmonella enterica
MSYTLPSLPYAYDALEPHFDKQTMAIHHTKHHQTYVNNANAALENLPEFADLPVEELITKLDQVPADKKTVLRNNAGGHANHSLFWKGLKKGTTLQGDLKAAIERDFGSVDNFKAEFEKAAATRFGSGWAWLVLKGDKLAVVSTANQDSPLMGEAISGASGFPILGLDVWEHAYYLKFQNRRPDYIKEFWNVVNWDEAAARFAAKK

SEQ ID NO: 768 - protein, 127 aa, Salmonella enterica; identical to SEQ ID NO: 577

SEQ ID NO: 769 - protein, 103 aa, Salmonella enterica; identical to SEQ ID NO: 578

SEQ ID NO: 770 - protein, 130 aa, Salmonella enterica; identical to SEQ ID NO: 579

SEQ ID NO: 771 - protein, 144 aa, Salmonella enterica; identical to SEQ ID NO: 580

SEQ ID NO: 772 - protein, 156 aa, Salmonella enterica
MPRRRVIGQRKILPDPKFGSELLAKFVNILMVDGKKSTAESIAYSALETLAQRSGKSELEAFEVALENVRPTVEVKSRRVGGSTYQVPVEVRPVRRNALAMRWIVEAARKRGDKSMALRLANELSDAADNKGTAVKKREDVHRMAEANKAFAHYRW

SEQ ID NO: 773 - protein, 57 aa, Salmonella enterica; identical to SEQ ID NO: 582

SEQ ID NO: 774 - protein, 69 aa, Salmonella enterica; identical to SEQ ID NO: 583

SEQ ID NO: 775 - protein, 93 aa, Salmonella enterica; identical to SEQ ID NO: 584

SEQ ID NO: 776 - protein, 94 aa, Salmonella enterica; identical to SEQ ID NO: 585

SEQ ID NO: 777 - protein, 206 aa, Salmonella enterica; identical to SEQ ID NO: 576

SEQ ID NO: 778 - protein, 127 aa, Salmonella enterica; identical to SEQ ID NO: 577

SEQ ID NO: 779 - protein, 103 aa, Salmonella enterica; identical to SEQ ID NO: 578

SEQ ID NO: 780 - protein, 130 aa, Salmonella enterica; identical to SEQ ID NO: 579

SEQ ID NO: 781 - protein, 144 aa, Salmonella enterica
MRLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTIRGLRVTKGARAAIEAAGGKIEE

SEQ ID NO: 782 - protein, 57 aa, Salmonella enterica; identical to SEQ ID NO: 582

SEQ ID NO: 783 - protein, 69 aa, Salmonella enterica; identical to SEQ ID NO: 583

SEQ ID NO: 784 - protein, 93 aa, Salmonella enterica; identical to SEQ ID NO: 584

SEQ ID NO: 785 - protein, 94 aa, Salmonella enterica; identical to SEQ ID NO: 585

SEQ ID NO: 786 - protein, 206 aa, Salmonella enterica; identical to SEQ ID NO: 712

SEQ ID NO: 787 - protein, 127 aa, Salmonella enterica; identical to SEQ ID NO: 577

SEQ ID NO: 788 - protein, 103 aa, Salmonella enterica; identical to SEQ ID NO: 578

SEQ ID NO: 789 - protein, 130 aa, Salmonella enterica; identical to SEQ ID NO: 579

SEQ ID NO: 790 - protein, 144 aa, Salmonella enterica; identical to SEQ ID NO: 580

SEQ ID NO: 791 - protein, 156 aa, Salmonella enterica; identical to SEQ ID NO: 581

SEQ ID NO: 792 - protein, 94 aa, Salmonella enterica; identical to SEQ ID NO: 585

SEQ ID NO: 793 - protein, 206 aa, Salmonella enterica; identical to SEQ ID NO: 712

SEQ ID NO: 794 - protein, 127 aa, Salmonella enterica; identical to SEQ ID NO: 577

SEQ ID NO: 795 - protein, 103 aa, Salmonella enterica; identical to SEQ ID NO: 714

SEQ ID NO: 796 - protein, 130 aa, Salmonella enterica; identical to SEQ ID NO: 579

SEQ ID NO: 797 - protein, 144 aa, Salmonella enterica; identical to SEQ ID NO: 580

SEQ ID NO: 798 - protein, 156 aa, Salmonella enterica; identical to SEQ ID NO: 581

SEQ ID NO: 799 - protein, 94 aa, Salmonella enterica; identical to SEQ ID NO: 585

SEQ ID NO: 800 - protein, 206 aa, Salmonella enterica; identical to SEQ ID NO: 588

SEQ ID NO: 801 - protein, 127 aa, Salmonella enterica; identical to SEQ ID NO: 577

SEQ ID NO: 802 - protein, 103 aa, Salmonella enterica; identical to SEQ ID NO: 578

SEQ ID NO: 803 - protein, 130 aa, Salmonella enterica; identical to SEQ ID NO: 579

SEQ ID NO: 804 - protein, 144 aa, Salmonella enterica; identical to SEQ ID NO: 580

SEQ ID NO: 805 - protein, 156 aa, Salmonella enterica; identical to SEQ ID NO: 593

SEQ ID NO: 806 - protein, 94 aa, Salmonella enterica; identical to SEQ ID NO: 585

SEQ ID NO: 807 - protein, 206 aa, Salmonella enterica
MSYTLPSLPYAYDALEPHFDKQTMEIHHTKHHQTYVNNANAALENLPEFADLPVEELITKLDQVPADKKTVLRNNAGGHANHSLFWKGLKKGTTLQGDLKAAIERDFGSVDNFKAEFEKAAATRFGSGWAWLVLKGDKLAVVSTANQDSPLMGEAVSGASGFPILGLDVWEHAYYLKFQNRRPDYIKEFWNVVNWDEAAARFAAKK

SEQ ID NO: 808 - protein, 127 aa, Salmonella enterica; identical to SEQ ID NO: 577

SEQ ID NO: 809 - protein, 103 aa, Salmonella enterica; identical to SEQ ID NO: 578

SEQ ID NO: 810 - protein, 130 aa, Salmonella enterica; identical to SEQ ID NO: 579

SEQ ID NO: 811 - protein, 144 aa, Salmonella enterica; identical to SEQ ID NO: 580

SEQ ID NO: 812 - protein, 156 aa, Salmonella enterica; identical to SEQ ID NO: 593

SEQ ID NO: 813 - protein, 94 aa, Salmonella enterica
MFTINAEVRKEQGKGASRRLRAANKFPAIIYGGSEAPVAIELDHDQVMNMQAKAEFYSEVLTLVVDGKEVKVKAQAVQRHAYKPKLTHIDFVRA

SEQ ID NO: 814 - protein, 206 aa, Salmonella enterica
MSYTLPSLPYAYDALEPHFDKQTMEIHHTKHHQTYVNNANAALENLPEFADLPVEELITKLDQVPADKKTVLRNNAGGHANHSFFWKGLKKGSTLQGDLKAAIERDFGSVDNFKAEFEKAAATRFGSGWAWLVLKGDKLAVVSTANQDSPLMGEAISGASGFPILGLDVWEHAYYLKFQNRRPDYIKEFWNVVNWDEAAARFAAKK

SEQ ID NO: 815 - protein, 127 aa, Salmonella enterica; identical to SEQ ID NO: 577

SEQ ID NO: 816 - protein, 103 aa, Salmonella enterica; identical to SEQ ID NO: 578

SEQ ID NO: 817 - protein, 94 aa, Salmonella enterica; identical to SEQ ID NO: 585

SEQ ID NO: 818 - protein, 130 aa, Salmonella enterica; identical to SEQ ID NO: 579

SEQ ID NO: 819 - protein, 144 aa, Salmonella enterica; identical to SEQ ID NO: 580

SEQ ID NO: 820 - protein, 156 aa, Salmonella enterica; identical to SEQ ID NO: 581

SEQ ID NO: 821 - protein, 206 aa, Salmonella enterica; identical to SEQ ID NO: 576

SEQ ID NO: 822 - protein, 127 aa, Salmonella enterica; identical to SEQ ID NO: 577

SEQ ID NO: 823 - protein, 103 aa, Salmonella enterica; identical to SEQ ID NO: 578

SEQ ID NO: 824 - protein, 130 aa, Salmonella enterica; identical to SEQ ID NO: 579

SEQ ID NO: 825 - protein, 144 aa, Salmonella enterica; identical to SEQ ID NO: 580

SEQ ID NO: 826 - protein, 156 aa, Salmonella enterica; identical to SEQ ID NO: 581

SEQ ID NO: 827 - protein, 94 aa, Salmonella enterica; identical to SEQ ID NO: 585

SEQ ID NO: 828 - protein, 206 aa, Salmonella enterica; identical to SEQ ID NO: 712

SEQ ID NO: 829 - protein, 127 aa, Salmonella enterica; identical to SEQ ID NO: 577

SEQ ID NO: 830 - protein, 103 aa, Salmonella enterica; identical to SEQ ID NO: 714

SEQ ID NO: 831 - protein, 130 aa, Salmonella enterica; identical to SEQ ID NO: 579

SEQ ID NO: 832 - protein, 144 aa, Salmonella enterica; identical to SEQ ID NO: 580

SEQ ID NO: 833 - protein, 156 aa, Salmonella enterica; identical to SEQ ID NO: 581

SEQ ID NO: 834 - protein, 57 aa, Salmonella enterica; identical to SEQ ID NO: 582

SEQ ID NO: 835 - protein, 69 aa, Salmonella enterica; identical to SEQ ID NO: 583

SEQ ID NO: 836 - protein, 93 aa, Salmonella enterica; identical to SEQ ID NO: 584

SEQ ID NO: 837 - protein, 94 aa, Salmonella enterica; identical to SEQ ID NO: 585

SEQ ID NO: 838 - protein, 167 aa, Salmonella enterica; identical to SEQ ID NO: 596

SEQ ID NO: 839 - protein, 206 aa, Salmonella enterica; identical to SEQ ID NO: 712

SEQ ID NO: 840 - protein, 127 aa, Salmonella enterica; identical to SEQ ID NO: 577

SEQ ID NO: 841 - protein, 103 aa, Salmonella enterica; identical to SEQ ID NO: 578

SEQ ID NO: 842 - protein, 130 aa, Salmonella enterica; identical to SEQ ID NO: 579

SEQ ID NO: 843 - protein, 144 aa, Salmonella enterica; identical to SEQ ID NO: 580

SEQ ID NO: 844 - protein, 156 aa, Salmonella enterica; identical to SEQ ID NO: 593

SEQ ID NO: 845 - protein, 57 aa, Salmonella enterica; identical to SEQ ID NO: 582

SEQ ID NO: 846 - protein, 69 aa, Salmonella enterica
MAKIGENVPLLIDKAVDFMASSQAFREYLNKTPPRDYVPSEVPSESAPIYLQRLEYYRRLYRPKEEERS

SEQ ID NO: 847 - protein, 93 aa, Salmonella enterica; identical to SEQ ID NO: 584

SEQ ID NO: 848 - protein, 94 aa, Salmonella enterica; identical to SEQ ID NO: 585

SEQ ID NO: 849 - protein, 206 aa, Salmonella enterica; identical to SEQ ID NO: 576

SEQ ID NO: 850 - protein, 127 aa, Salmonella enterica; identical to SEQ ID NO: 577

SEQ ID NO: 851 - protein, 103 aa, Salmonella enterica; identical to SEQ ID NO: 578

SEQ ID NO: 852 - protein, 130 aa, Salmonella enterica; identical to SEQ ID NO: 579

SEQ ID NO: 853 - protein, 144 aa, Salmonella enterica; identical to SEQ ID NO: 580

SEQ ID NO: 854 - protein, 156 aa, Salmonella enterica; identical to SEQ ID NO: 581

SEQ ID NO: 855 - protein, 57 aa, Salmonella enterica; identical to SEQ ID NO: 582

SEQ ID NO: 856 - protein, 69 aa, Salmonella enterica
MAKIGENVPLLIDKAVDFMASSQAFREYLNKTPPRDYVPSEVPSESAPIYLQRLAYYRRLYRPKEEERG

SEQ ID NO: 857 - protein, 93 aa, Salmonella enterica; identical to SEQ ID NO: 584

SEQ ID NO: 858 - protein, 94 aa, Salmonella enterica; identical to SEQ ID NO: 585

SEQ ID NO: 859 - protein, 63 aa, Salmonella enterica; identical to SEQ ID NO: 595

SEQ ID NO: 860 - protein, 206 aa, Salmonella enterica; identical to SEQ ID NO: 712

SEQ ID NO: 861 - protein, 127 aa, Salmonella enterica; identical to SEQ ID NO: 577

SEQ ID NO: 862 - protein, 103 aa, Salmonella enterica; identical to SEQ ID NO: 578

SEQ ID NO: 863 - protein, 130 aa, Salmonella enterica; identical to SEQ ID NO: 579

SEQ ID NO: 864 - protein, 144 aa, Salmonella enterica; identical to SEQ ID NO: 580

SEQ ID NO: 865 - protein, 156 aa, Salmonella enterica; identical to SEQ ID NO: 581

SEQ ID NO: 866 - protein, 57 aa, Salmonella enterica; identical to SEQ ID NO: 708

SEQ ID NO: 867 - protein, 69 aa, Salmonella enterica; identical to SEQ ID NO: 583

SEQ ID NO: 868 - protein, 93 aa, Salmonella enterica; identical to SEQ ID NO: 584

SEQ ID NO: 869 - protein, 94 aa, Salmonella enterica; identical to SEQ ID NO: 585

SEQ ID NO: 870 - protein, 206 aa, Salmonella enterica; identical to SEQ ID NO: 712

SEQ ID NO: 871 - protein, 127 aa, Salmonella enterica; identical to SEQ ID NO: 577

SEQ ID NO: 872 - protein, 103 aa, Salmonella enterica; identical to SEQ ID NO: 714

SEQ ID NO: 873 - protein, 130 aa, Salmonella enterica; identical to SEQ ID NO: 579

SEQ ID NO: 874 - protein, 144 aa, Salmonella enterica; identical to SEQ ID NO: 580

SEQ ID NO: 875 - protein, 156 aa, Salmonella enterica; identical to SEQ ID NO: 581

SEQ ID NO: 876 - protein, 94 aa, Salmonella enterica; identical to SEQ ID NO: 585

SEQ ID NO: 877 - protein, 206 aa, Salmonella enterica; identical to SEQ ID NO: 712

SEQ ID NO: 878 - protein, 127 aa, Salmonella enterica; identical to SEQ ID NO: 577

SEQ ID NO: 879 - protein, 103 aa, Salmonella enterica; identical to SEQ ID NO: 578

SEQ ID NO: 880 - protein, 130 aa, Salmonella enterica; identical to SEQ ID NO: 579

SEQ ID NO: 881 - protein, 144 aa, Salmonella enterica; identical to SEQ ID NO: 580

SEQ ID NO: 882 - protein, 156 aa, Salmonella enterica; identical to SEQ ID NO: 581

SEQ ID NO: 883 - protein, 57 aa, Salmonella enterica; identical to SEQ ID NO: 708

SEQ ID NO: 884 - protein, 69 aa, Salmonella enterica; identical to SEQ ID NO: 583

SEQ ID NO: 885 - protein, 93 aa, Salmonella enterica; identical to SEQ ID NO: 584

SEQ ID NO: 886 - protein, 94 aa, Salmonella enterica; identical to SEQ ID NO: 585

SEQ ID NO: 887 - protein, 206 aa, Salmonella enterica; identical to SEQ ID NO: 712

SEQ ID NO: 888 - protein, 127 aa, Salmonella enterica; identical to SEQ ID NO: 577

SEQ ID NO: 889 - protein, 103 aa, Salmonella enterica; identical to SEQ ID NO: 714

SEQ ID NO: 890 - protein, 130 aa, Salmonella enterica; identical to SEQ ID NO: 579

SEQ ID NO: 891 - protein, 144 aa, Salmonella enterica; identical to SEQ ID NO: 580

SEQ ID NO: 892 - protein, 156 aa, Salmonella enterica; identical to SEQ ID NO: 581

SEQ ID NO: 893 - protein, 94 aa, Salmonella enterica; identical to SEQ ID NO: 585

SEQ ID NO: 894 - protein, 206 aa, Salmonella enterica
MSYTLPSLPYAYDALEPHFDKQTMEIHHTKHHQTYVNNANAALENLPEFADLPVEELITKLDQVPADKKTVLRNNAGGHANHSLFWKGLKKGTTLQGDLKVAIERDFGSVDNFKAEFEKAAATRFGSGWAWLVLKGDKLAVVSTANQDSPLMGEAISGASGFPILGLDVWEHAYYLKFQNRRPDYIKEFWNVVNWDEAAARFAAKK

SEQ ID NO: 895 - protein, 127 aa, Salmonella enterica; identical to SEQ ID NO: 577

SEQ ID NO: 896 - protein, 103 aa, Salmonella enterica; identical to SEQ ID NO: 578

SEQ ID NO: 897 - protein, 130 aa, Salmonella enterica
MSMQDPIADMLTRIRNGQAANKAAVTMPSSKLKVAIANVLKEEGFIEDFKVEGDTKPELELILKYFQGKAVVESIQRVSRPGLRIYKRKDELPKVMAGLGIAVVSTSKGVMTDRAARQAGLGGEIICYVA

SEQ ID NO: 898 - protein, 144 aa, Salmonella enterica; identical to SEQ ID NO: 580

SEQ ID NO: 899 - protein, 156 aa, Salmonella enterica; identical to SEQ ID NO: 593

SEQ ID NO: 900 - protein, 94 aa, Salmonella enterica; identical to SEQ ID NO: 585

SEQ ID NO: 901 - protein, 206 aa, Salmonella enterica; identical to SEQ ID NO: 576

SEQ ID NO: 902 - protein, 127 aa, Salmonella enterica; identical to SEQ ID NO: 577

SEQ ID NO: 903 - protein, 103 aa, Salmonella enterica; identical to SEQ ID NO: 578

SEQ ID NO: 904 - protein, 130 aa, Salmonella enterica; identical to SEQ ID NO: 579

SEQ ID NO: 905 - protein, 144 aa, Salmonella enterica; identical to SEQ ID NO: 580

SEQ ID NO: 906 - protein, 156 aa, Salmonella enterica; identical to SEQ ID NO: 581

SEQ ID NO: 907 - protein, 57 aa, Salmonella enterica; identical to SEQ ID NO: 582

SEQ ID NO: 908 - protein, 69 aa, Salmonella enterica; identical to SEQ ID NO: 583

SEQ ID NO: 909 - protein, 93 aa, Salmonella enterica
MAKMAAALHILVKEEKMALDLLEQIKNGGDFEKLAKKHSICPSGKKGGHLGEFRQGQMVPAFDKVVFSCPVLEPTGPLHTQFGYHIIKVLYRK

SEQ ID NO: 910 - protein, 94 aa, Salmonella enterica; identical to SEQ ID NO: 585

SEQ ID NO: 911 - protein, 206 aa, Salmonella enterica; identical to SEQ ID NO: 894

SEQ ID NO: 912 - protein, 127 aa, Salmonella enterica; identical to SEQ ID NO: 577

SEQ ID NO: 913 - protein, 103 aa, Salmonella enterica; identical to SEQ ID NO: 578

SEQ ID NO: 914 - protein, 130 aa, Salmonella enterica; identical to SEQ ID NO: 897

SEQ ID NO: 915 - protein, 144 aa, Salmonella enterica; identical to SEQ ID NO: 580

SEQ ID NO: 916 - protein, 156 aa, Salmonella enterica; identical to SEQ ID NO: 593

SEQ ID NO: 917 - protein, 94 aa, Salmonella enterica; identical to SEQ ID NO: 585

SEQ ID NO: 918 - protein, 206 aa, Salmonella enterica; identical to SEQ ID NO: 894

SEQ ID NO: 919 - protein, 127 aa, Salmonella enterica; identical to SEQ ID NO: 577

SEQ ID NO: 920 - protein, 103 aa, Salmonella enterica; identical to SEQ ID NO: 578

SEQ ID NO: 921 - protein, 130 aa, Salmonella enterica; identical to SEQ ID NO: 897

SEQ ID NO: 922 - protein, 144 aa, Salmonella enterica; identical to SEQ ID NO: 580

SEQ ID NO: 923 - protein, 156 aa, Salmonella enterica; identical to SEQ ID NO: 593

SEQ ID NO: 924 - protein, 94 aa, Salmonella enterica; identical to SEQ ID NO: 585

SEQ ID NO: 925 - protein, 206 aa, Salmonella enterica; identical to SEQ ID NO: 894

SEQ ID NO: 926 - protein, 127 aa, Salmonella enterica; identical to SEQ ID NO: 577

SEQ ID NO: 927 - protein, 103 aa, Salmonella enterica; identical to SEQ ID NO: 578

SEQ ID NO: 928 - protein, 130 aa, Salmonella enterica; identical to SEQ ID NO: 897

SEQ ID NO: 929 - protein, 144 aa, Salmonella enterica; identical to SEQ ID NO: 580

SEQ ID NO: 930 - protein, 156 aa, Salmonella enterica; identical to SEQ ID NO: 593

SEQ ID NO: 931 - protein, 94 aa, Salmonella enterica; identical to SEQ ID NO: 585

SEQ ID NO: 932 - protein, 206 aa, Salmonella enterica; identical to SEQ ID NO: 894

SEQ ID NO: 933 - protein, 127 aa, Salmonella enterica; identical to SEQ ID NO: 577

SEQ ID NO: 934 - protein, 103 aa, Salmonella enterica; identical to SEQ ID NO: 578

SEQ ID NO: 935 - protein, 130 aa, Salmonella enterica; identical to SEQ ID NO: 897

SEQ ID NO: 936 - protein, 144 aa, Salmonella enterica; identical to SEQ ID NO: 580

SEQ ID NO: 937 - protein, 156 aa, Salmonella enterica; identical to SEQ ID NO: 593

SEQ ID NO: 938 - protein, 94 aa, Salmonella enterica; identical to SEQ ID NO: 585

SEQ ID NO: 939 - protein, 206 aa, Salmonella enterica; identical to SEQ ID NO: 894

SEQ ID NO: 940 - protein, 127 aa, Salmonella enterica; identical to SEQ ID NO: 577

SEQ ID NO: 941 - protein, 103 aa, Salmonella enterica; identical to SEQ ID NO: 578

SEQ ID NO: 942 - protein, 130 aa, Salmonella enterica; identical to SEQ ID NO: 897

SEQ ID NO: 943 - protein, 144 aa, Salmonella enterica; identical to SEQ ID NO: 580

SEQ ID NO: 944 - protein, 156 aa, Salmonella enterica; identical to SEQ ID NO: 593

SEQ ID NO: 945 - protein, 94 aa, Salmonella enterica; identical to SEQ ID NO: 585

SEQ ID NO: 946 - protein, 206 aa, Salmonella enterica; identical to SEQ ID NO: 712

SEQ ID NO: 947 - protein, 127 aa, Salmonella enterica; identical to SEQ ID NO: 577

SEQ ID NO: 948 - protein, 103 aa, Salmonella enterica; identical to SEQ ID NO: 578

SEQ ID NO: 949 - protein, 130 aa, Salmonella enterica; identical to SEQ ID NO: 579

SEQ ID NO: 950 - protein, 144 aa, Salmonella enterica; identical to SEQ ID NO: 580

SEQ ID NO: 951 - protein, 156 aa, Salmonella enterica; identical to SEQ ID NO: 593

SEQ ID NO: 952 - protein, 57 aa, Salmonella enterica; identical to SEQ ID NO: 708

SEQ ID NO: 953 - protein, 93 aa, Salmonella enterica; identical to SEQ ID NO: 584

SEQ ID NO: 954 - protein, 94 aa, Salmonella enterica; identical to SEQ ID NO: 585

SEQ ID NO: 955 - protein, 167 aa, Salmonella enterica; identical to SEQ ID NO: 587

SEQ ID NO: 956 - protein, 206 aa, Salmonella enterica; identical to SEQ ID NO: 712

SEQ ID NO: 957 - protein, 127 aa, Salmonella enterica; identical to SEQ ID NO: 577

SEQ ID NO: 958 - protein, 103 aa, Salmonella enterica; identical to SEQ ID NO: 578

SEQ ID NO: 959 - protein, 130 aa, Salmonella enterica; identical to SEQ ID NO: 579

SEQ ID NO: 960 - protein, 144 aa, Salmonella enterica; identical to SEQ ID NO: 580

SEQ ID NO: 961 - protein, 156 aa, Salmonella enterica; identical to SEQ ID NO: 593

SEQ ID NO: 962 - protein, 57 aa, Salmonella enterica; identical to SEQ ID NO: 708

SEQ ID NO: 963 - protein, 69 aa, Salmonella enterica; identical to SEQ ID NO: 583

SEQ ID NO: 964 - protein, 93 aa, Salmonella enterica; identical to SEQ ID NO: 584

SEQ ID NO: 965 - protein, 94 aa, Salmonella enterica; identical to SEQ ID NO: 585

SEQ ID NO: 966 - protein, 206 aa, Salmonella enterica; identical to SEQ ID NO: 576

SEQ ID NO: 967 - protein, 127 aa, Salmonella enterica; identical to SEQ ID NO: 577

SEQ ID NO: 968 - protein, 103 aa, Salmonella enterica; identical to SEQ ID NO: 578

SEQ ID NO: 969 - protein, 130 aa, Salmonella enterica; identical to SEQ ID NO: 579

SEQ ID NO: 970 - protein, 144 aa, Salmonella enterica; identical to SEQ ID NO: 580

SEQ ID NO: 971 - protein, 156 aa, Salmonella enterica; identical to SEQ ID NO: 581

SEQ ID NO: 972 - protein, 57 aa, Salmonella enterica; identical to SEQ ID NO: 582

SEQ ID NO: 973 - protein, 69 aa, Salmonella enterica; identical to SEQ ID NO: 583

SEQ ID NO: 974 - protein, 93 aa, Salmonella enterica; identical to SEQ ID NO: 909

SEQ ID NO: 975 - protein, 94 aa, Salmonella enterica; identical to SEQ ID NO: 585

SEQ ID NO: 976 - protein, 206 aa, Salmonella enterica; identical to SEQ ID NO: 712

SEQ ID NO: 977 - protein, 130 aa, Salmonella enterica; identical to SEQ ID NO: 579

SEQ ID NO: 978 - protein, 144 aa, Salmonella enterica
MHLNTLSPAEGSKKAGKRLGRGIGSGLGKTGGRGHKGQKSRSGGGVRRGFEGGQMPLYRRLPKFGFTSRKAAITAEVRLSDLAKVEGGVVDLNTLKAANIIGIQIEFAKVILAGEVTTPVTVRGLRVTKGARAAIEAAGGKIEE

SEQ ID NO: 979 - protein, 156 aa, Salmonella enterica; identical to SEQ ID NO: 593

SEQ ID NO: 980 - protein, 57 aa, Salmonella enterica; identical to SEQ ID NO: 582

SEQ ID NO: 981 - protein, 73 aa, Salmonella enterica
  SITE 73: note = misc_feature - X can be any naturally occurring amino acid
MAKIGENVPLLIDKAVDFMASSQAFREYLNKTPPRDYVPSEVPSESAPIYLQRLEYYRRLYRPKEEERGRRDX

SEQ ID NO: 982 - protein, 93 aa, Salmonella enterica; identical to SEQ ID NO: 584

SEQ ID NO: 983 - protein, 206 aa, Salmonella enterica; identical to SEQ ID NO: 712

SEQ ID NO: 984 - protein, 127 aa, Salmonella enterica; identical to SEQ ID NO: 577

SEQ ID NO: 985 - protein, 103 aa, Salmonella enterica; identical to SEQ ID NO: 578

SEQ ID NO: 986 - protein, 130 aa, Salmonella enterica; identical to SEQ ID NO: 579

SEQ ID NO: 987 - protein, 144 aa, Salmonella enterica; identical to SEQ ID NO: 580

SEQ ID NO: 988 - protein, 156 aa, Salmonella enterica; identical to SEQ ID NO: 593

SEQ ID NO: 989 - protein, 57 aa, Salmonella enterica; identical to SEQ ID NO: 582

SEQ ID NO: 990 - protein, 70 aa, Salmonella enterica
MAKIGENVPLLIDKAVDFMASSQAFREYLNKTPPRDYVPSEVPSESAPIYLQRLEYYRRLYRPKEERGRR

SEQ ID NO: 991 - protein, 93 aa, Salmonella enterica; identical to SEQ ID NO: 584

SEQ ID NO: 992 - protein, 57 aa, Salmonella enterica; identical to SEQ ID NO: 708

SEQ ID NO: 993 - protein, 69 aa, Salmonella enterica; identical to SEQ ID NO: 856

SEQ ID NO: 994 - protein, 93 aa, Salmonella enterica; identical to SEQ ID NO: 584

SEQ ID NO: 995 - protein, 167 aa, Salmonella enterica
MNIKTVEDLFIHLLSDTYSAEKQLTKALPKLARATSNEKLSQAFQSHLEETQGQIERIDQIVESESGIKLKRIKCVAMEGLIEEANEVIESTEKNEVRDAALIAAAQKVEHYEIASYGTLATLAEQLGYGKALKLLKETLDEEKQTDLKLTDLAVSNVNKSAERKSK

SEQ ID NO: 996 - protein, 206 aa, Salmonella enterica; identical to SEQ ID NO: 712

SEQ ID NO: 997 - protein, 103 aa, Salmonella enterica; identical to SEQ ID NO: 578

SEQ ID NO: 998 - protein, 130 aa, Salmonella enterica; identical to SEQ ID NO: 579

SEQ ID NO: 999 - protein, 144 aa, Salmonella enterica; identical to SEQ ID NO: 580

SEQ ID NO: 1000 - protein, 156 aa, Salmonella enterica; identical to SEQ ID NO: 593

SEQ ID NO: 1001 - protein, 57 aa, Salmonella enterica; identical to SEQ ID NO: 582

SEQ ID NO: 1002 - protein, 69 aa, Salmonella enterica; identical to SEQ ID NO: 583

SEQ ID NO: 1003 - protein, 93 aa, Salmonella enterica; identical to SEQ ID NO: 584

SEQ ID NO: 1004 - protein, 206 aa, Salmonella enterica; identical to SEQ ID NO: 712

SEQ ID NO: 1005 - protein, 127 aa, Salmonella enterica; identical to SEQ ID NO: 577

SEQ ID NO: 1006 - protein, 103 aa, Salmonella enterica; identical to SEQ ID NO: 578

SEQ ID NO: 1007 - protein, 130 aa, Salmonella enterica; identical to SEQ ID NO: 579

SEQ ID NO: 1008 - protein, 144 aa, Salmonella enterica; identical to SEQ ID NO: 580

SEQ ID NO: 1009 - protein, 156 aa, Salmonella enterica; identical to SEQ ID NO: 593

SEQ ID NO: 1010 - protein, 57 aa, Salmonella enterica; identical to SEQ ID NO: 708

SEQ ID NO: 1011 - protein, 69 aa, Salmonella enterica
MAKIGENVPLLIDKAVDFMASSQAFREFKYKTPPRDYVPSEVPSESAPIYLQRLAYYRRLYRPKEEERG

SEQ ID NO: 1012 - protein, 93 aa, Salmonella enterica; identical to SEQ ID NO: 584

SEQ ID NO: 1013 - protein, 206 aa, Salmonella enterica
MSYTLPSLPYAYDALEPHFDKQTMEIHHTKHHQTYVNNANAALENLPEFADLPAEELITKLDQVPADKKTVLRNNAGGHANHSLFWKGLKKGTTLQGDLKAAIERDFGSVDNFKAEFEKAAATRFGSGWAWLVLKGDKLAVVSTANQDSPLMGEAISGASGFPILGLDVWEHAYYLKFQNRRPDYIKEFWNVVNWDEAAARFAAKK

SEQ ID NO: 1014 - protein, 103 aa, Salmonella enterica; identical to SEQ ID NO: 714

SEQ ID NO: 1015 - protein, 130 aa, Salmonella enterica; identical to SEQ ID NO: 579

SEQ ID NO: 1016 - protein, 144 aa, Salmonella enterica; identical to SEQ ID NO: 580

SEQ ID NO: 1017 - protein, 57 aa, Salmonella enterica; identical to SEQ ID NO: 582

SEQ ID NO: 1018 - protein, 69 aa, Salmonella enterica; identical to SEQ ID NO: 583

SEQ ID NO: 1019 - protein, 93 aa, Salmonella enterica; identical to SEQ ID NO: 584

SEQ ID NO: 1020 - protein, 206 aa, Salmonella enterica; identical to SEQ ID NO: 712

SEQ ID NO: 1021 - protein, 127 aa, Salmonella enterica; identical to SEQ ID NO: 577

SEQ ID NO: 1022 - protein, 103 aa, Salmonella enterica; identical to SEQ ID NO: 578

SEQ ID NO: 1023 - protein, 130 aa, Salmonella enterica; identical to SEQ ID NO: 579

SEQ ID NO: 1024 - protein, 144 aa, Salmonella enterica; identical to SEQ ID NO: 580

SEQ ID NO: 1025 - protein, 156 aa, Salmonella enterica; identical to SEQ ID NO: 593

SEQ ID NO: 1026 - protein, 57 aa, Salmonella enterica; identical to SEQ ID NO: 708

SEQ ID NO: 1027 - protein, 69 aa, Salmonella enterica; identical to SEQ ID NO: 856

SEQ ID NO: 1028 - protein, 93 aa, Salmonella enterica; identical to SEQ ID NO: 584

SEQ ID NO: 1029 - protein, 206 aa, Salmonella enterica; identical to SEQ ID NO: 576

SEQ ID NO: 1030 - protein, 127 aa, Salmonella enterica; identical to SEQ ID NO: 577

SEQ ID NO: 1031 - protein, 103 aa, Salmonella enterica; identical to SEQ ID NO: 578

SEQ ID NO: 1032 - protein, 130 aa, Salmonella enterica; identical to SEQ ID NO: 579

SEQ ID NO: 1033 - protein, 144 aa, Salmonella enterica; identical to SEQ ID NO: 580

SEQ ID NO: 1034 - protein, 156 aa, Salmonella enterica; identical to SEQ ID NO: 593

SEQ ID NO: 1035 - protein, 57 aa, Salmonella enterica; identical to SEQ ID NO: 582

SEQ ID NO: 1036 - protein, 69 aa, Salmonella enterica; identical to SEQ ID NO: 583

SEQ ID NO: 1037 - protein, 93 aa, Salmonella enterica; identical to SEQ ID NO: 584

SEQ ID NO: 1038 - protein, 206 aa, Salmonella enterica; identical to SEQ ID NO: 712

SEQ ID NO: 1039 - protein, 127 aa, Salmonella enterica; identical to SEQ ID NO: 577

SEQ ID NO: 1040 - protein, 103 aa, Salmonella enterica; identical to SEQ ID NO: 578

SEQ ID NO: 1041 - protein, 130 aa, Salmonella enterica; identical to SEQ ID NO: 579

SEQ ID NO: 1042 - protein, 144 aa, Salmonella enterica; identical to SEQ ID NO: 580

SEQ ID NO: 1043 - protein, 156 aa, Salmonella enterica; identical to SEQ ID NO: 593

SEQ ID NO: 1044 - protein, 57 aa, Salmonella enterica; identical to SEQ ID NO: 708

SEQ ID NO: 1045 - protein, 69 aa, Salmonella enterica; identical to SEQ ID NO: 856

SEQ ID NO: 1046 - protein, 93 aa, Salmonella enterica; identical to SEQ ID NO: 584

SEQ ID NO: 1047 - protein, 206 aa, Salmonella enterica; identical to SEQ ID NO: 894

SEQ ID NO: 1048 - protein, 127 aa, Salmonella enterica; identical to SEQ ID NO: 577

SEQ ID NO: 1049 - protein, 130 aa, Salmonella enterica; identical to SEQ ID NO: 897

SEQ ID NO: 1050 - protein, 144 aa, Salmonella enterica; identical to SEQ ID NO: 580

SEQ ID NO: 1051 - protein, 156 aa, Salmonella enterica; identical to SEQ ID NO: 593

SEQ ID NO: 1052 - protein, 57 aa, Salmonella enterica; identical to SEQ ID NO: 582

SEQ ID NO: 1053 - protein, 69 aa, Salmonella enterica; identical to SEQ ID NO: 583

SEQ ID NO: 1054 - protein, 93 aa, Salmonella enterica; identical to SEQ ID NO: 584

SEQ ID NO: 1055 - protein, 206 aa, Salmonella enterica; identical to SEQ ID NO: 712

SEQ ID NO: 1056 - protein, 127 aa, Salmonella enterica; identical to SEQ ID NO: 577

SEQ ID NO: 1057 - protein, 103 aa, Salmonella enterica; identical to SEQ ID NO: 578

SEQ ID NO: 1058 - protein, 130 aa, Salmonella enterica; identical to SEQ ID NO: 579

SEQ ID NO: 1059 - protein, 144 aa, Salmonella enterica; identical to SEQ ID NO: 580

SEQ ID NO: 1060 - protein, 124 aa, Salmonella enterica
MATVNQLVRKPRARKVAKSNVPALEACPQKRGVCTRVYTTTPKKPNSALRKVCRVRLTNGFEVTSYIGGEGHNLQEHSVILIRGGRVKDLPGVRYHTVRGALDCSGVKDRKQARSKYGVKRPKA

SEQ ID NO: 1061 - protein, 57 aa, Salmonella enterica; identical to SEQ ID NO: 708

SEQ ID NO: 1062 - protein, 69 aa, Salmonella enterica; identical to SEQ ID NO: 583

SEQ ID NO: 1063 - protein, 93 aa, Salmonella enterica; identical to SEQ ID NO: 584

SEQ ID NO: 1064 - protein, 94 aa, Salmonella enterica; identical to SEQ ID NO: 813

SEQ ID NO: 1065 - protein, 206 aa, Salmonella enterica; identical to SEQ ID NO: 712

SEQ ID NO: 1066 - protein, 127 aa, Salmonella enterica; identical to SEQ ID NO: 577

SEQ ID NO: 1067 - protein, 103 aa, Salmonella enterica; identical to SEQ ID NO: 578

SEQ ID NO: 1068 - protein, 130 aa, Salmonella enterica; identical to SEQ ID NO: 579

SEQ ID NO: 1069 - protein, 144 aa, Salmonella enterica; identical to SEQ ID NO: 580

SEQ ID NO: 1070 - protein, 156 aa, Salmonella enterica; identical to SEQ ID NO: 593

SEQ ID NO: 1071 - protein, 57 aa, Salmonella enterica; identical to SEQ ID NO: 708

SEQ ID NO: 1072 - protein, 69 aa, Salmonella enterica; identical to SEQ ID NO: 583

SEQ ID NO: 1073 - protein, 93 aa, Salmonella enterica; identical to SEQ ID NO: 584

SEQ ID NO: 1074 - protein, 94 aa, Salmonella enterica; identical to SEQ ID NO: 813

SEQ ID NO: 1075 - protein, 206 aa, Salmonella enterica; identical to SEQ ID NO: 1013

SEQ ID NO: 1076 - protein, 256 aa, Salmonella enterica
  SITE 256: note = misc_feature - X can be any naturally occurring amino acid
MKEEKPEFDPICCACRSGIYWSALLTASRQKLSTISVIWYSVPRLSFLRRLTWVKNLLPRLKTCWLPVDCLWVCAWKTGHRQASLTSNRITGGFTEKDKVMRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKTEAAAESVVTKNPLRRVFLYPPEPHVSTIIVFFSX

SEQ ID NO: 1077 - protein, 103 aa, Salmonella enterica; identical to SEQ ID NO: 714

SEQ ID NO: 1078 - protein, 130 aa, Salmonella enterica; identical to SEQ ID NO: 579

SEQ ID NO: 1079 - protein, 144 aa, Salmonella enterica; identical to SEQ ID NO: 580

SEQ ID NO: 1080 - protein, 156 aa, Salmonella enterica; identical to SEQ ID NO: 593

SEQ ID NO: 1081 - protein, 57 aa, Salmonella enterica; identical to SEQ ID NO: 582

SEQ ID NO: 1082 - protein, 93 aa, Salmonella enterica; identical to SEQ ID NO: 584

SEQ ID NO: 1083 - protein, 206 aa, Salmonella enterica; identical to SEQ ID NO: 1013

SEQ ID NO: 1084 - protein, 127 aa, Salmonella enterica; identical to SEQ ID NO: 577

SEQ ID NO: 1085 - protein, 130 aa, Salmonella enterica; identical to SEQ ID NO: 579

SEQ ID NO: 1086 - protein, 144 aa, Salmonella enterica; identical to SEQ ID NO: 580

SEQ ID NO: 1087 - protein, 156 aa, Salmonella enterica; identical to SEQ ID NO: 593

SEQ ID NO: 1088 - protein, 57 aa, Salmonella enterica; identical to SEQ ID NO: 582

SEQ ID NO: 1089 - protein, 93 aa, Salmonella enterica; identical to SEQ ID NO: 584

SEQ ID NO: 1090 - protein, 127 aa, Salmonella enterica; identical to SEQ ID NO: 577

SEQ ID NO: 1091 - protein, 130 aa, Salmonella enterica; identical to SEQ ID NO: 579

SEQ ID NO: 1092 - protein, 144 aa, Salmonella enterica; identical to SEQ ID NO: 580

SEQ ID NO: 1093 - protein, 156 aa, Salmonella enterica; identical to SEQ ID NO: 593

SEQ ID NO: 1094 - protein, 57 aa, Salmonella enterica; identical to SEQ ID NO: 582

SEQ ID NO: 1095 - protein, 93 aa, Salmonella enterica; identical to SEQ ID NO: 584

The invention claimed is:

1. A method of identifying a serovar of *Salmonella* bacteria comprising
    a) a step of subjecting a sample containing microorganisms to mass spectrometry to obtain a mass spectrum,
    b) a step of reading a mass-to-charge ratio m/z of a peak derived from a marker protein from the mass spectrum, and
    c) an identification step of identifying a serovar of *Salmonella* bacteria in the sample, based on the mass-to-charge ratio m/z,
    wherein the serovars of *Salmonella* bacteria are classified using cluster analysis using as an index the mass-to-charge ratio m/z derived from at least 12 types of ribosomal proteins S8, L15, L17, L21, L25, S7, SODa, peptidylprolyl isomerase, gns, YibT, YaiA and YciF as the marker proteins.

2. The method according to claim 1, further comprising a step of generating a dendrogram representing an identification result by the cluster analysis.

* * * * *